US008632764B2

(12) United States Patent
Xiao et al.

(10) Patent No.: US 8,632,764 B2
(45) Date of Patent: Jan. 21, 2014

(54) DIRECTED EVOLUTION AND IN VIVO PANNING OF VIRUS VECTORS

(75) Inventors: Xiao Xiao, Chapel Hill, NC (US); Lin Yang, Wuhan (CN)

(73) Assignee: University of North Carolina at Chapel Hill, Chapel Hill, NC (US)

( * ) Notice: Subject to any disclaimer, the term of this patent is extended or adjusted under 35 U.S.C. 154(b) by 260 days.

(21) Appl. No.: 12/990,460

(22) PCT Filed: Apr. 29, 2009

(86) PCT No.: PCT/US2009/002608
§ 371 (c)(1),
(2), (4) Date: Dec. 10, 2010

(87) PCT Pub. No.: WO2009/137006
PCT Pub. Date: Nov. 12, 2009

(65) Prior Publication Data
US 2011/0104120 A1    May 5, 2011

Related U.S. Application Data

(60) Provisional application No. 61/049,160, filed on Apr. 30, 2008.

(51) Int. Cl.
*A01N 63/00* (2006.01)
*A61K 48/00* (2006.01)
*C12Q 1/70* (2006.01)
*C07H 19/00* (2006.01)
*C07H 21/00* (2006.01)

(52) U.S. Cl.
USPC ............ 424/93.2; 424/93.6; 435/5; 536/22.1; 536/23.72

(58) Field of Classification Search
None
See application file for complete search history.

(56) References Cited

U.S. PATENT DOCUMENTS

| 6,759,237 B1 | 7/2004 | Wilson et al. |
| 2007/0036760 A1 | 2/2007 | Wilson et al. |

OTHER PUBLICATIONS

Denti M. et al., "Body-wide gene therapy of Duchenne muscular dystrophy in the mdx mouse model", *PNAS*, vol. 103 No. 10, Mar. 7, 2006, pp. 3758-3763.
Goyenvalle, A. et al., "Rescue of Dystrophic Muscle Through U7 snRNA-Mediated Exon Skipping", *Science*, vol. 306, Dec. 3, 2004, pp. 1796-1799.
Li W. et al., "Engineering and Selection of Shuffled AAV Genomes: A New Strategy for Producing Targeted Biological Nanoparticles", *Molecular Therapy*, vol. 16 No. 7, Jul. 2008, pp. 1252-1260.
Maheshri N. et al., "Directed evolution of adeno-associated virus yields enhanced gene delivery vectors", *Nature Biotechnology*, vol. 24 No. 2, Feb. 2006, pp. 198-204.
Muller O. et al., "Random peptide libraries displayed on adeno-associated virus to select for targeted gene therapy vectors", *Nature Biotechnology*, vol. 21 No. 9, Sep. 2003, pp. 1040-1046.
Soong, Nay-Wei et al., "Molecular breeding of viruses", *Nature Genetics*, vol. 25, Aug. 2000, pp. 436-439.
Stemmer, William P.C., "DNA shuffling by random fragmentation and reassemble: In vitro recombination for molecular evolution", *Proceedings of the National Academy Sciences*, USA, vol. 91, pp. 10747-10751, Oct. 1994.
Work L. et al., "Vascular Bed-Targeted in Vivo Gene Delivery Using Tropism-Modified Adeno-associated Viruses", *Molecular Therapy*, vol. 13 No. 4, Apr. 2006, pp. 683-693.
Wu Z. et al., "Single Amino Acid Changes Can Influence Titer, Heparin Binding, and Tissue Tropism in different Adeno-Associated Virus Serotypes", *Journal of Virology*, vol. 80 No. 22, Nov. 2006, p. 11393-11397.
Yang L. et al., "A myocardium tropic adeno-associated virus (AAV) evolved by DNA shuffling and in vivo selection", *PNAS*, vol. 106 No. 10, Mar. 10, 2009, pp. 3946-3951 (Supporting Information, 4 pages).

*Primary Examiner* — Valarie Bertoglio
(74) *Attorney, Agent, or Firm* — Myers Bigel Sibley & Sajovec, P.A.

(57) ABSTRACT

The present invention provides methods of achieving directed evolution of viruses by in vivo screening or "panning" to identify viruses comprising scrambled AAV capsids having characteristics of interest, e.g., tropism profile and/or neutralization profile (e.g., ability to evade neutralizing antibodies). The invention also provides scrambled AAV capsids and virus particles comprising the same.

25 Claims, 78 Drawing Sheets

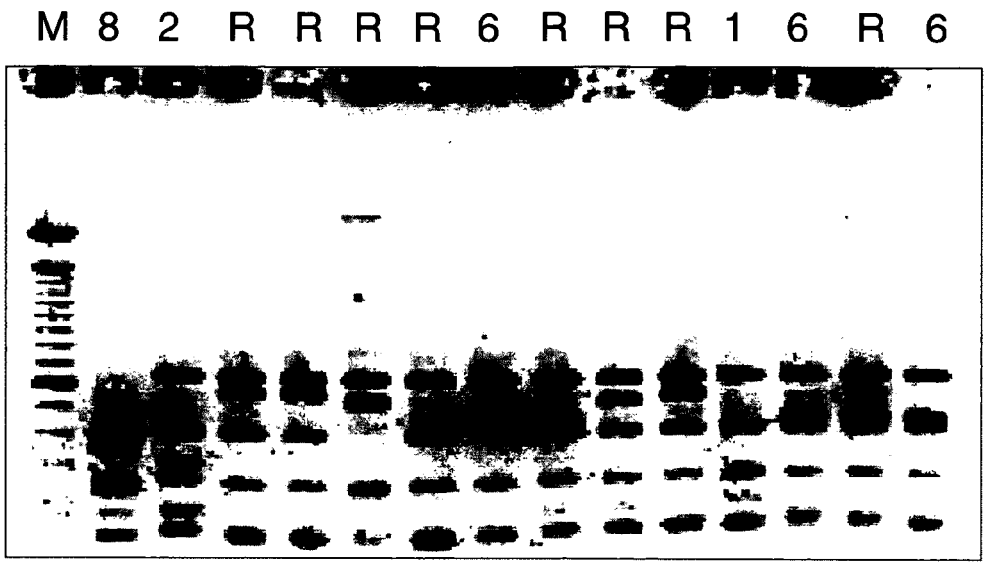
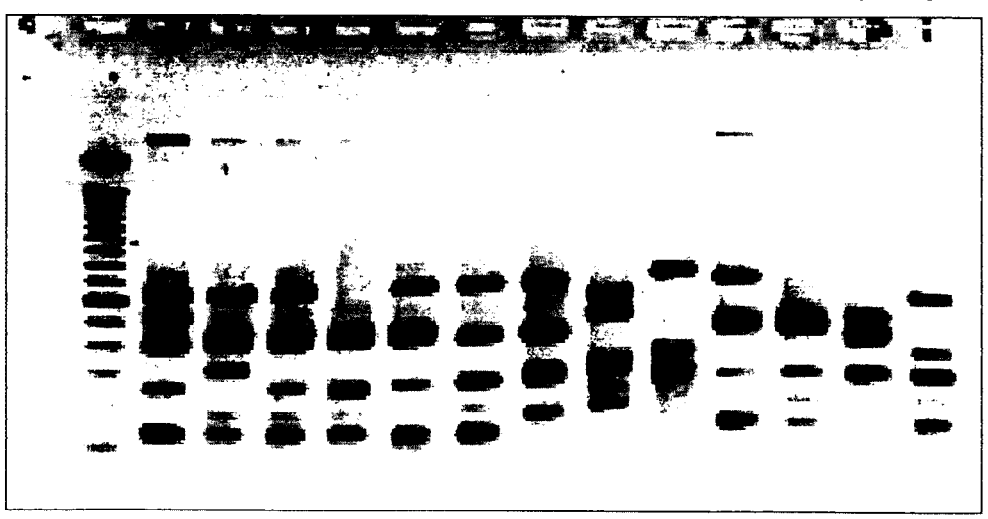
FIG. 1

| AAV MUTANTS | FREQUENCY OF APPEARANCE IN MUSCLE | FREQUENCY OF APPEARANCE IN LIVER |
|---|---|---|
| M41 | 12 | 0 |
| M66 | 7 | 1 |
| M120 | 6 | 3 |
| M13 | 3 | 0 |
| M148 | 2 | 0 |
| M62 | 2 | 0 |
| M125 | 2 | 0 |
| M151 | 2 | 0 |
| M10 | 2 | 1 |
| M67 | 2 | 1 |

FIG. 2

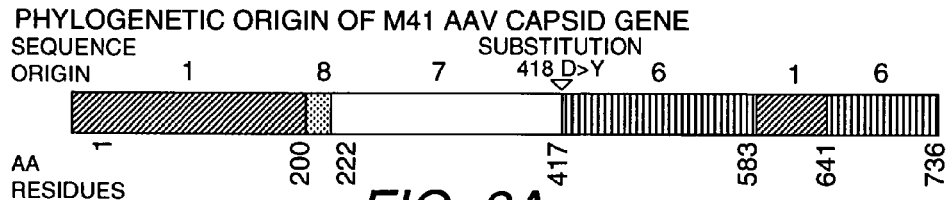

FIG. 3A

M41 CODING SEQUENCE (SEQ ID NO:1)
ATGGCTGCCGATGGTTATCTTCCAGATTGGCTCGAGGACAACCTCTCTGAGGGCATTCGCGAGTGGTGGG
ACTTGAAACCTGGAGCCCCGAAACCCAAAGCCAACCAGCAAAAGCAGGACGACGGCCGGGGTCTGGTGCT
TCCTGGCTACAAGTACCTCGGACCCTTCAACGGACTCGACAAGGGGGAGCCCGTCAACGCGGCGGATGCA
GCGGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGCGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCTAAAAAGAGACTCAATTTTGGTCAGACTGGCGACTCAGAGTCAGTCCCCGATCCACAACC
TCTCGGAGAACCTCCAGCAACCCCCGCTGCTGTGGGACCTAATACAATGGCTGCAGGCGGTGGCGCACCA
ATGGCAGACAATAACGAAGGCGCCGACGGAGTGGGTAATGCCTCAGGAAATTGGCATTGCGATTCCACAT
GGCTGGGCGACAGAGTCATCACCACCAGCACCCGAACATGGGCCTTGCCCACCTATAACAACCACCTCTA
CAAGCAAATCTCCAGTGAAACTGCAGGTAGTACCAACGACAACACCTACTTCGGCTACAGCACCCCCTGG
GGGTATTTTGACTTTAACAGATTCCACTGCCACTTCTCACCACGTGACTGGCAGCGACTCATCAACAACA
ACTGGGGATTCCGGCCCAAGAAGCTGCGGTTCAAGCTCTTCAACATCCAGGTCAAGGAGGTCACGACGAA
TGACGGCGTTACGACCATCGCTAATAACCTTACCAGCACGATTCAGGTATTCTCGGACTCGGAATACCAG
CTGCCGTACGTCCTCGGCTCTGCGCACCAGGGCTGCCTGCCCTCCGTTCCCGGCGGACGTCTTCATGATTC
CTCAGTACGGCTACCTGACTCTCAACAATGGCAGTCAGTCTGTGGGACGTTCCTCCTTCTACTGCCTGGA
GTACTTCCCCTCTCAGATGCTGAGAACGGGCAACAACTTTGAGTTCAGCTACAGCTTCGAGTACGTGCCT
TTCCACAGCAGCTACGCACACAGCCAGAGCCTGGACCGGCTGATGAATCCTCTCATCGACCAATACCTGT
ATTACCTGAACAGAACTCAGAATCAGTCCGGAAGTGCCCAAAACAAGGACTTGCTGTTTAGCCGGGGGTC
TCCAGCTGGCATGTCTGTTCAGCCCAAAAACTGGCTACCTGGACCCTGTTACCGGCAGCAGCGCGTTTCT
AAAACAAAAACAGACAACAACAACAGCAACTTTACCTGGACTGGTGCTTCAAAATATAACCTCAATGGGC
GTGAATCCATCATCAACCCTGGCACTGCTATGGCCTCACACAAAGACGACAAAGACAAGTTCTTTCCCAT
GAGCGGTGTCATGATTTTTGGAAAGGAGAGCGCCGGAGCTTCAAACACTGCATTGGACAATGTCATGATT
ACAGACGAAGAGGAAATTAAAGCCACTAACCCTGTGGCCACCGAAAGATTTGGGACCGTGGCAGTCAATT
TCCAGAGCAGCAGCACAGACCCTGCGACCGGAGATGTGCATGCTATGGGAGCATTACCTGGCATGGTGTG
GCAAGATAGAGACGTGTACCTGCAGGGTCCCATTTGGGCCAAAATTCCTCACACAGATGGACACTTTCAC
CCGTCTCCTCTCATGGGCGGCTTTGGACTTAAGCACCCGCCTCCTCAGATCCTCATCAAAAACACGCCTG
TTCCTGCGAATCCTCCGGCAGAGTTTTCGGCTACAAAGTTTGCTTCATTCATCACCCAATACTCCACAGG
ACAAGTGAGTGTGGAAATTGAATGGGAGCTGCAGAAAGAAAACAGCAAGCGCTGGAATCCCGAAGTGCAG
TACACATCCAATTATGCAAAATCTGCCAACGTTGATTTCACTGTGGACAACAATGGACTTTATACTGAGC
CTCGCCCCATTGGCACCCGTTACCTCACCCGTCCCCTGTAA

FIG. 3B

M41 AMINO ACID SEQUENCE (SEQ ID NO:2)
MAADGYLPDWLEDNLSEGIREWWDLKPGAPKPKANQQKQDDGRGLVLPGYKYLGPFNGLDKGEPVNAADA
AALEHDKAYDQQLKAGDNPYLRYNHADAEFQERLQEDTSFGGNLGRAVFQAKKRVLEPLGLVEEGAKTAP
GKKRPVEQSPQEPDSSSGIGKTGQQPAKKRLNFGQTGDSESVPDPQPLGEPPATPAAVGPNTMAAGGGAP
MADNNEGADGVGNASGNWHCDSTWLGDRVITTSTRTWALPTYNNHLYKQISSETAGSTNDNTYFGYSTPW
GYFDFNRFHCHFSPRDWQRLINNNWGFRPKKLRFKLFNIQVKEVTTNDGVTTIANNLTSTIQVFSDSEYQ
LPYVLGSAHQGCLPPFPADVFMIPQYGYLTLNNGSQSVGRSSFYCLEYFPSQMLRTGNNFEFSYSFEYVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNFQSSSTDPATGDVHAMGALPGMVWQDRDVYLQGPIWAKIPHTDGHFH
PSPLMGGFGLKHPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3C

PHYLOGENETIC ORIGIN OF M17 AAV CAPSID GENE

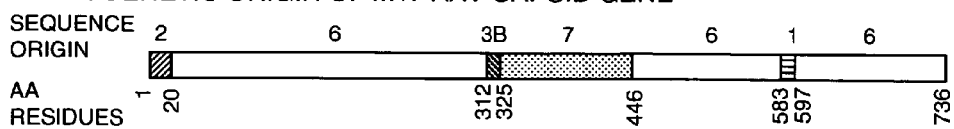

FIG. 3D

M17 CODING SEQUENCE (SEQ ID NO:3)
ATGGCTGCCGATGGTTATCTTCCAGATTGGCTCGAGGACACTCTCTCTGAGGGCATTCGCGAGTGGTGGG
ACCTGAAACCTGGAGCCCCGAAACCCAAAGCCAACCAGCAAAAGCAGGACAACGGCCGGGGTCTGGTGCT
TCCTGGCTACAAGTACCTCGGACCCTTCAACGGACTCGACAAGGGGGAACCCGTCAACGCAGCGGACGCG
GCAGCCCTCGAGCACGACAAAGCCTACGACCAGCAGCTCAAGGCCGGTGACAACCCGTACCTCAAGTACA
ACCACGCCGACGCCGAGTTTCAGGAGCGTCTGCAAGAAGATACGTCATTTGGGGGCAACCTCGGGCGAGC
AGTCTTCCAGGCCAAGAAGCGGGTTCTCGAACCTTTTGGTCTGGTTGAGGAAGGTGCTAAGACGGCTCCT
GGAAAGAAACGTCCGGTAGAGCAGTCGCCACAAGAGCCAGACTCCTCCTCGGGCATTGGCAAGACAGGCC
AGCAGCCCGCTAAAAAGAGACTCAATTTTGGTCAGACTGGCGACTCAGAGTCAGTCCCCGACCCACAACC
TCTCGGAGAACCTCCAGCAACCCCCGCTGCTGTGGGACCTACTACAATGGCTTCAGGCGGTGGCGCACCA
ATGGCAGACAATAACGAAGGCGCCGACGGAGTGGGTAATGCCTCAGGAAATTGGCATTGCGATTCCACAT
GGCTGGGCGACAGAGTCATCACCACCAGCACCCGCACCTGGGCCTTGCCCACCTACAATAACCACCTCTA
CAAGCAAATCTCCAGTGCTTCAACGGGGGCCAGCAACGACAACCACTACTTCGGCTACAGCACCCCCTGG
GGGTATTTTGATTTCAACAGATTCCACTGCCACTTTTCACCACGTGACTGGCAGCGACTCATCAACAACA
ATTGGGGATTCCGGCCCAAGAGACTCAGCTTCAAGCTCTTCAACATCCAAGTCAAGGAGGTCACGACGAA
TGACGGCGTTACGACCATCGCTAATAACCTTACCAGCACGATTCAGGTATTCTCGGACTCGGAATACCAG
CTGCCGTACGTCCTCGGCTCTGCGCACCAGGGCTGCCTCCCTCCGTTCCCGGCGGACGTGTTCATGATTC
CGCAGTACGGCTACCTAACGCTCAACAATGGCAGCCAGGCAGTGGGACGGTCATCCTTTTACTGCCTGGA
ATATTTCCCATCGCAGATGCTGAGAACGGGCAATAACTTTGAGTTCAGCTACAGCTTCGAGGACGTGCCT
TTCCACAGCAGCTACGCGCACAGCCAGAGCCTGGACCGGCTGATGAATCCTCTCATCGACCAGTACCTGT
ATTACCTGAACAGAACTCAGAATCAGTCCGGAAGTGCCCAAAACAAGGACTTGCTGTTTAGCCGGGGGTC
TCCAGCTGGCATGTCTGTTCAGCCCAAAAACTGGCTACCTGGACCCTGTTACCGGCAGCAGCGCGTTTCT
AAAACAAAAACAGACAACAACAACAGCAACTTTACCTGGACTGGTGCTTCAAAATATAACCTTAATGGGC
GTGAATCTATAATCAACCCTGGCACTGCTATGGCCTCACACAAAGACGACAAAGACAAGTTCTTTCCCAT
GAGCGGTGTCATGATTTTTGGAAAGGAGAGCGCCGGAGCTTCAAACACTGCATTGGACAATGTCATGATC
ACAGACGAAGAGGAAATCAAAGCCACTAACCCCGTGGCCACCGAAAGATTTGGGACCGTGGCAGTCAATT
TCCAGAGCAGCAGCACAGACCCTGCGACCGGAGATGTGCATGTTATGGGAGCCTTACCTGGAATGGTGTG
GCAAGACAGAGACGTATACCTGCAGGGTCCTATTTGGGCCAAAATTCCTCACACGGATGGACACTTTCAC
CCGTCTCCTCTCATGGGCGGCTTTGGACTTAAGCACCCGCCTCCTCAGATCCTCATCAAAAACACGCCTG
TTCCTGCGAATCCTCCGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAACGCTGGAATCCCGAAGTGCAG
TATACATCTAACTATGCAAAATCTGCCAACGTTGATTTTACTGTGGACAACAATGGACTTTATACTGAGC
CTCGCCCCATTGGCACCCGTTACCTTACCCGTCCCCTGTAA

FIG. 3E

M17 AMINO ACID SEQUENCE (SEQ ID NO:4)
MAADGYLPDWLEDTLSEGIREWWDLKPGAPKPKANQQKQDNGRGLVLPGYKYLGPFNGLDKGEPVNAADA
AALEHDKAYDQQLKAGDNPYLKYNHADAEFQERLQEDTSFGGNLGRAVFQAKKRVLEPFGLVEEGAKTAP
GKKRPVEQSPQEPDSSSGIGKTGQQPAKKRLNFGQTGDSESVPDPQPLGEPPATPAAVGPTTMASGGGAP
MADNNEGADGVGNASGNWHCDSTWLGDRVITTSTRTWALPTYNNHLYKQISSASTGASNDNHYFGYSTPW
GYFDFNRFHCHFSPRDWQRLINNNWGFRPKRLSFKLFNIQVKEVTTNDGVTTIANNLTSTIQVFSDSEYQ
LPYVLGSAHQGCLPPFPADVFMIPQYGYLTLNNGSQAVGRSSFYCLEYFPSQMLRTGNNFEFSYSFEDVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNFQSSSTDPATGDVHVMGALPGMVWQDRDVYLQGPIWAKIPHTDGHFH
PSPLMGGFGLKHPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3F

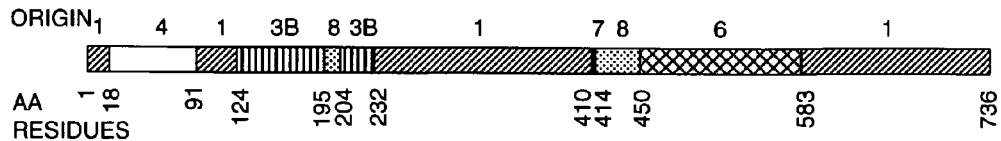

FIG. 3G

PHYLOGENETIC ORIGIN OF M22 AAV CAPSID GENE

M22 CODING SEQUENCE (SEQ ID NO:5)
ATGGCTGCCGATGGTTATCTTCCAGATTGGCTCGAGGACAACCTCTCTGAGGGCGTTCGAGAGTGGTGGG
CGCTGCAACCTGGAGCCCCTAAACCCAAGGCAAATCAACAACATCAGGACAACGCTCGGGGTCTTGTGCT
TCCGGGTTACAAATACCTCGGACCCGGCAACGGACTCGACAAGGGGGAACCCGTCAACGCAGCGGACGCG
GCAGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAAAAGAGGATCCTTGAGCCTCTTGGTCTGGTTGAGGAAGCAGCTAAAACGGCTCCT
GGAAAGAAGAGGCCTGTAGATCAGTCTCCTCAGGAACCGGACTCATCATCTGGTGTTGGCAAATCGGGCA
AACAGCCTGCCAGAAAAAGACTAAATTTCGGTCAGACTGGCGACTCAGAGTCAGTCCCAGACCCTCAACC
TCTCGGAGAACCTCCAGCAGCGCCCTCTGGTGTGGGACCTAATACAATGGCTTCAGGTGGTGGCGCACCA
ATGGCAGACAATAACGAGGGTGCCGATGGAGTGGGTAATTCCTCAGGAAATTGGCATTGCGATTCCACAT
GGCTGGGCGACAGAGTCATCACCACCAGCACCCGAACATGGGCCTTGCCCACCTACAATAACCACCTCTA
CAAGCAAATCTCCAGTGCTTCAACGGGGCCAGCAACGACAACCACTACTTTGGCTACAGCACCCCCTGG
GGGTATTTTGATTTCAACAGATTCCACTGCCATTTCTCACCACGTGACTGGCAGCGACTCATCAACAACA
ACTGGGGATTCCGGCCAAGAGACTCAACTTCAAACTCTTCAACATCCAAGTCAAGGAGGTCACGACGAA
TGACGGCGTTACGACCATCGCTAATAACCTTACCAGCACGGTTCAAGTCTTCTCGGACTCGGAGTACCAG
CTGCCGTACGTCCTCGGCTCTGCGCACCAGGGCTGCCTGCCTCCGTTCCCGGCGGACGTGTTCATGATTC
CGCAGTACGGCTACCTAACGCTCAACAATGGCAGCCAGGCAGTGGGACGGTCATCCTTTTACTGCCTGGA
ATATTTCCCTTCTCAGATGCTGAGAACGGGCAACAACTTTGAGTTCAGCTACACTTTTGAGGACGTTCCT
TTCCACAGCAGCTACGCTCACAGCCAGAGTCTGGACCGTCTCATGAATCCTCTCATCGACCAGTACCTGT
ATTACTTGAGCAGAACTCAAAATCAGTCCGGAAGTGCCCAAAACAAGGACTTGCTGTTTAGCCGTGGGTC
TCCAGCTGGCATGTCTGTTCAGCCCAAAAACTGGCTACCTGGACCCTGTTATCGGCAGCAGCGCGTTTCT
AAAACAAAAACAGACAACAACAACAGCAACTTTACCTGGACTGGTGCTTCAAAATATAACCTTAATGGGC
GTGAATCTATAATCAACCCTGGCACTGCTATGGCCTCACACAAAGACGACAAAGACAAGTTCTTTCCCAT
GAGCGGTGTCATGATTTTTGGAAAGGAGAGCGCCGGAGCTTCAAACACTGCATTGGACAATGTCATGATC
ACAGACGAAGAGGAAATTAAAGCCACTAACCCTGTGGCCACCGAAAGATTTGGGACCGTGGCAGTCAATT
TCCAGAGCAGCAGCACAGACCCTGCGACCGGAGATGTGCATGCTATGGGAGCATTACCTGGCATGGTGTG
GCAAGATAGAGACGTATACCTGCAGGGTCCTATTTGGGCCAAAATTCCTCACACGGATGGACACTTTCAC
CCGTCTCCTCTTATGGGCGGCTTTGGACTCAAGAACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAGCGCTGGAATCCCGAAGTGCAG
TACACATCCAATTATGCAAAATCTGCCAACGTTGATTTACTGTGGACAACAATGGACTTTATACTGAGC
CTCGCCCCATTGGCACCCGTTACCTTACCCGTCCCCTGTAA

FIG. 3H

M22 AMINO ACID SEQUENCE (SEQ ID NO:6)
MAADGYLPDWLEDNLSEGVREWWALQPGAPKPKANQQHQDNARGLVLPGYKYLGPGNGLDKGEPVNAADA
AALEHDKAYDQQLKAGDNPYLRYNHADAEFQERLQEDTSFGGNLGRAVFQAKKRILEPLGLVEEAAKTAP
GKKRPVDQSPQEPDSSSGVGKSGKQPARKRLNFGQTGDSESVPDPQPLGEPPAAPSGVGPNTMASGGGAP
MADNNEGADGVGNSSGNWHCDSTWLGDRVITTSTRTWALPTYNNHLYKQISSASTGASNDNHYFGYSTPW
GYFDFNRFHCHFSPRDWQRLINNNWGFRPKRLNFKLFNIQVKEVTTNDGVTTIANNLTSTVQVFSDSEYQ
LPYVLGSAHQGCLPPFPADVFMIPQYGYLTLNNGSQAVGRSSFYCLEYFPSQMLRTGNNFEFSYTFEDVP
FHSSYAHSQSLDRLMNPLIDQYLYYLSRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNFQSSSTDPATGDVHAMGALPGMVWQDRDVYLQGPIWAKIPHTDGHFH
PSPLMGGFGLKNPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3I

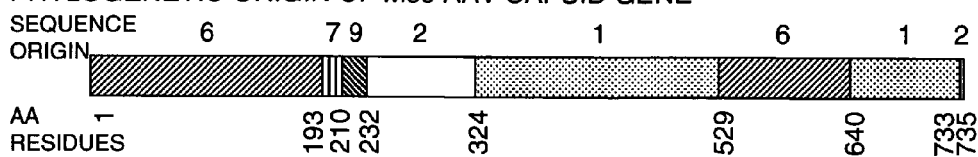

FIG. 3J

M35 CODING SEQUENCE (SEQ ID NO:7)
ATGGCTGCCGATGGTTATCTTCCAGATTGGCTCGAGGACAACCTCTCTGAGGGCATTCGCGAGTGGTGGG
ACTTGAAACCTGGAGCCCCGAAGCCCAAAGCCAACCAGCAAAAGCAGGACGACGGCCGGGGTCTGGTGCT
TCCTGGCTACAAGTACCTCGGACCCTTCAACGGACTCGACAAGGGGGAGCCCGTCAACGCGGCGGACGCA
GCGGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGCAACCTCGGGCGAGC
AGTCTTCCAGGCCAAGAAGAGGGTTCTCGAACCTTTTGGTCTGGTTGAGGAAGGTGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCCAGAAGAGACTCAATTTCGGTCAGACTGGCGACTCAGAGTCAGTCCCCGACCCTCAACC
TCTCGGAGAACCTCCAGCAGCGCCCTCTAGTGTGGGATCTGGTACAGTGGCTGCAGGTGGTGGCGCACCA
GTGGCAGACAATAACGAAGGCGCCGACGGAGTGGGTAGTTCCTCGGGAAATTGGCATTGCGATTCCACAT
GGATGGGCGACAGAGTCATCACCACCAGCACCCGAACCTGGGCCCTGCCCACCTACAACAACCACCTCTA
CAAACAAATTTCCAGCCAATCAGGAGCCTCGAACGACAATCACTACTTTGGCTACAGCACCCCTTGGGGG
TATTTTGACTTCAACAGATTCCACTGCCACTTTTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGACGTTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCGCACAGCCAGAGCCTGGACTGCGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGAATGGTGTGGCA
AGACAGAGACGTGTACCTGCAGGGTCCCATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCGGAGTTTTCAGCTACAAAGTTTGCTTCATTCATCACCCAATACTCCACAGGACA
AGTGAGTGTGGAAATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTAATCTGTAA

FIG. 3K

M35 AMINO ACID SEQUENCE (SEQ ID NO:8)
AADGYLPDWLEDNLSEGIREWWDLKPGAPKPKANQQKQDDGRGLVLPGYKYLGPFNGLDKGEPVNAADAA
ALEHDKAYDQQLKAGDNPYLRYNHADAEFQERLQEDTSFGGNLGRAVFQAKKRVLEPFGLVEEGAKTAPG
KKRPVEQSPQEPDSSSGIGKTGQQPARKRLNFGQTGDSESVPDPQPLGEPPAAPSSVGSGTVAAGGGAPV
ADNNEGADGVGSSSGNWHCDSTWMGDRVITTSTRTWALPTYNNHLYKQISSQSGASNDNHYFGYSTPWGY
FDFNRFHCHFSPRDWQRLINNNWGFRPKRLNFKLFNIQVKEVTTNDGVTTIANNLTSTVQVFSDSEYQLP
YVLGSAHQGCLPPFPADVFMIPQYGYLTLNNGSQAVGRSSFYCLEYFPSQMLRTGNNFTFSYTFEEVPFH
SSYAHSQSLDRLMNPLIDQYLYYLNRTQNQSGSAQNKDLLFSRGSPAGMSVQPKNWLPGPCYRQQRVSKT
KTDNNNSNFTWTGASKYNLNGRESIINPGTAMASHKDDKDKFFPMSGVMIFGKESAGASNTALDNVMITD
EEEIKATNPVATERFGTVAVNLQSSSTDPATGDVHVMGALPGMVWQDRDVYLQGPIWAKIPHTDGHFHPS
PLMGGFGLKNPPPQILIKNTPVPANPPAEFSATKFASFITQYSTGQVSVEIEWELQKENSKRWNPEVQYT
SNYAKSANVDFTVDNNGLYTEPRPIGTRYLTRNL

FIG. 3L

PHYLOGENETIC ORIGIN OF M42 AAV CAPSID GENE

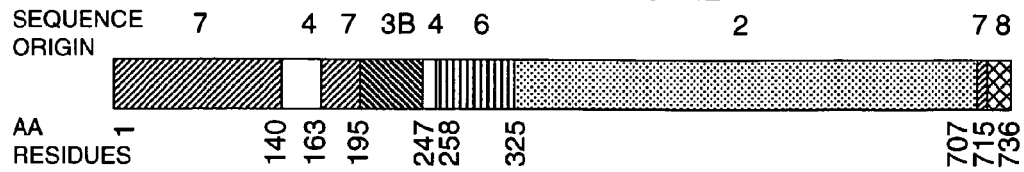

FIG. 3M

M42 CODING SEQUENCE (SEQ ID NO:9)
ATGGCTGCCGATGGTTATCTTCCAGATTGGCTCGAGGACAACCTCTCTGAGGGCATTCGCGAGTGGTGGG
ACCTGAAACCTGGAGCCCCGAAACCCAAAGCCAACCAGCAAAAGCAGGACAACGGCCGGGGTCTGGTGCT
TCCTGGCTACAAGTACCTCGGACCCTTCAACGGACTCGACAAGGGGGAGCCCGTCAACGCGGCGGACGCA
GCGGCCCTGGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGCGCTAAGACGGCTCCT
GGAAAGAAGAGACCGTTGATTGAATCCCCCAGCAGCCAGACTCCTCCACGGGCATCGGCAAGAAAGGCC
AGCAGCCCGCCAGAAAGAGACTCAATTTCGGTCAGACTGGCGACTCAGAGTCAGTCCCAGACCCTCAACC
TCTCGGAGAACCACCAGCAGCCCCACAAGTTTGGGATCTAATACAATGGCTTCAGGCGGTGGCGCACCA
ATGGCAGACAATAACGAGGGTGCCGATGGAGTGGGTAATTCCTCAGGAAATTGGCATTGCGATTCCCAAT
GGCTGGGGGACAGAGTCATCACCACCAGCACCAGAACCTGGTCTTGCCCACCTACAACAACCACCTCTA
CAAGCAAATCTCCAGTGCTTCAACGGGGGCCAGCAACGACAACCACTACTTCGGCTACAGCACCCCCTGG
GGGTATTTTGATTTCAACAGATTCCACTGCCATTTCTCACCACGTGACTGGCAGCGACTCATCAACAACA
ATTGGGGATTCCGGCCCAAGAGACTCAACTTCAAGCTCTTTAACATTCAAGTCAAAGAGGTCACGCAGAA
TGACGGTACGACGACGATTGCCAATAACCTTACCAGCACGGTTCAGGTGTTTACTGACTCGGAGTACCAG
CTCCCCGTACGTCCTCGGCTCGGCGCATCAAGGATGCCTCCCGCCGTTCCCAGCAGACGTCTTCATGGTGC
CACAGTATGGATACCTCACCCTGAACAACGGGAGTCAGGCAGTAGGACGCTCTTCATTTTACTGCCTGGA
GTACTTTCCTTCTCAGATGCTGCGTACCGGAAACAACTTTACCTTCAGCTACACTTTTGAGGACGTTCCT
TTCCACAGCAGCTACGCTCACAGCCAGAGTCTGGACCGTCTCATGAATCCTCTCATCGACCAGTACCTGT
ATTACTTGAGCAGAACAAACACTCCAAGTGGAACCACCACGCAGTCAAGGCTTCAGTTTTCTCAGGCCGG
AGCGAGTGACATTCGGGACCAGTCTAGGAACTGGCTTCCTGGACCCTGTTACCGCCAGCAGCGAGTATCA
AAGACATCTGCGGATAACAACAACAGTGAATACTCGTGGACTGGAGCTACCAAGTACCACCTCAATGGCA
GAGACTCTCTGGTGAATCCGGGCCCGGCCATGGCAAGCCACAAGGACGATGAAGAAAAGTTTTTTCCTCA
GAGCGGGGTTCTCATCTTTGGGAAGCAAGGCTCAGAGAAAACAAATGTGGACATTGAAAAGGTCATGATT
ACAGACGAAGAGGAAATCAGGACAACCAATCCCGTGGCTACGGAGCAGTATGGTTCTGTATCTACCAACC
TCCAGAGAGGCAACAGACAAGCAGCTACCGCAGATGTCAACACACAAGGCGTTCTTCCAGGCATGGTCTG
GCAGGACAGAGATGTGTACCTTCAGGGGCCCATCTGGGCAAAGATTCCACACACGGACGGACATTTTCAC
CCCTCTCCCCTCATGGGTGGATTCGGACTTAAACACCCTCCTCCACAGATTCTCATCAAGAACACCCCGG
TACCTGCGAATCCTTCGACCACCTTCAGTGCGGCAAAGTTTGCTTCCTTCATCACACAGTACTCCACGGG
ACAGGTCAGCGTGGAGATCGAGTGGGAGCTGCAGAAGGAAAACAGCAAACGCTGGAATCCCGAAATTCAG
TACACCTCCAACTTTGAAAAGCAGACTGGTGTGGACTTTGCTGTTAATACAGAAGGCGTGTACTCTGAAC
CCCGCCCCATTGGCACCCGTTACCTCACCCGTAATCTGTAA

FIG. 3N

M42 AMINO ACID SEQUENCE (SEQ ID NO:10)
MAADGYLPDWLEDNLSEGIREWWDLKPGAPKPKANQQKQDNGRGLVLPGYKYLGPFNGLDKGEPVNAADA
AALEHDKAYDQQLKAGDNPYLRYNHADAEFQERLQEDTSFGGNLGRAVFQAKKRVLEPLGLVEEGAKTAP
GKKRPLIESPQQPDSSTGIGKKGQQPARKRLNFGQTGDSESVPDPQPLGEPPAAPTSLGSNTMASGGAP
MADNNEGADGVGNSSGNWHCDSQWLGDRVITTSTRTWVLPTYNNHLYKQISSASTGASNDNHYFGYSTPW
GYFDFNRFHCHFSPRDWQRLINNNWGFRPKRLNFKLFNIQVKEVTQNDGTTTIANNLTSTVQVFTDSEYQ
LPYVLGSAHQGCLPPFPADVFMVPQYGYLTLNNGSQAVGRSSFYCLEYFPSQMLRTGNNFTFSYTFEDVP
FHSSYAHSQSLDRLMNPLIDQYLYYLSRTNTPSGTTTQSRLQFSQAGASDIRDQSRNWLPGPCYRQQRVS
KTSADNNNSEYSWTGATKYHLNGRDSLVNPGPAMASHKDDEEKFFPQSGVLIFGKQGSEKTNVDIEKVMI
TDEEEIRTTNPVATEQYGSVSTNLQRGNRQAATADVNTQGVLPGMVWQDRDVYLQGPIWAKIPHTDGHFH
PSPLMGGFGLKHPPPQILIKNTPVPANPSTTFSAAKFASFITQYSTGQVSVEIEWELQKENSKRWNPEIQ
YTSNFEKQTGVDFAVNTEGVYSEPRPIGTRYLTRNL

FIG. 3O

PHYLOGENETIC ORIGIN OF M62 AAV CAPSID GENE

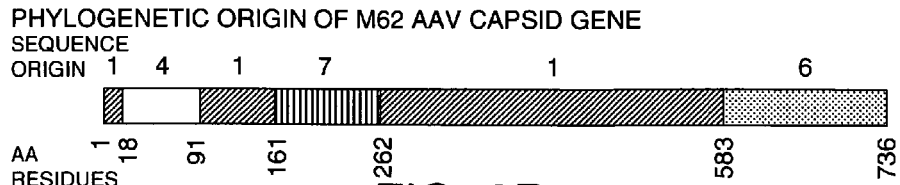

FIG. 3P

M62 CODING SEQUENCE (SEQ ID NO:11)
ATGGCTGCCGATGGTTATCTTCCAGATTGGCTCGAGGACAACCTCTCTGAAGGCGTTCGAGAGTGGTGGG
CGCTGCAACCTGGAGCCCCTAAACCCAAGGCAAATCAACAACATCAAGACAACGCTCGAGGTCTTGTGCT
TCCGGGTTACAAATACCTTGGACCCGGCAACGGACTCGACAAGGGGGAGCCGGTCAACGCAGCAGACGCG
GCGGCCCTCGAGCACGACAAGGCCTACGACCAGCAGCTCAAGGCCGGAGACAACCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGCGCTAAGACGGCTCCT
GGAAAGAAACGTCCGGTAGAGCAGTCGCCACAAGAGCCAGACTCCTCCTCGGGCATCGGCAAGAAAGGCC
AACAGCCCGCCAGAAAAAGACTCAATTTTGGTCAGACTGGCGACTCAGAGTCAGTTCCAGACCCTCAACC
TCTCGGAGAACCTCCAGCAGCGCCCTCTAGTGTGGGATCTGGTACAGTGGCTGCAGGCGGTGGCGCACCA
ATGGCAGACAATAACGAAGGTGCCGACGGAGTGGGTAATGCCTCAGGAAATTGGCATTGCGATTCCACAT
GGCTGGGCGACAGAGTCATTACCACCAGCACCCGAACCTGGGCCCTGCCCACCTACAACAACCACCTCTA
CAAGCAAATCTCCAGTGCTTCAACGGGGGCCAGCAACGACAACCACTACTTCGGCTACAGCACCCCCTGG
GGGTATTTTGATTTCAACAGATTCCACTGCCACTTCTCACCACGTGACTGGCAGCGACTCATCAACAACA
ATTGGGGATTCCGGCCCAAGAGACTCAACTTCAAGCTCTTCAACATCCAAGTCAAGGAGGTCACGACGAA
TGATGGCGTCACAACCATCGCTAATAACCTTACCAGCACGGTTCAAGTCTTCTCGGACTCGGAGTACCAG
TTGCCGTACGTCCTCGGCTCTGCGCACCAGGGCTGCCTCCCTCCGTTCCCGGCGGACGTGTTCATGATTC
CGCAGTACGGCTACCTAACGCTCAACAATGGCAGCCAGGCAGTGGGACGGTCATCCTTTTACTGCCTGGA
ATATTTCCCATCGCAGATGCTGAGAACGGGCAACAACTTTACCTTCAGCTACACCTTCGAGGACGTGCCT
TTCCACAGCAGCTACGCGCACAGCCAGAGCCTGGACCGGCTGATGAATCCTCTCATCGACCAGTACCTGT
ATTACCTGAACAGAACTCAGAATCAGTCCGGAAGTGCCCAAAACAAGGACTTGCTGTTTAGCCGGGGGTC
TCCAGCTGGCATGTCTGTTCAGCCCAAAAACTGGCTACCTGGACCCTGTTACCGGCAGCAGCGCGTTTCT
AAAACAAAAACAGACAACAACAACAGCAACTTTACCTGGACTGGTGCTTCAAAATATAACCTTAATGGGC
GTGAATCTATAATCAACCCTGGCACTGCTATGGCCTCACACAAAGACGACGAAGACAAGTTCTTTCCCAT
GAGCGGTGTCATGATTTTTGGAAAAGAGAGCGCCGGAGCTTCAAACACTGCATTGGACAATGTCATGATT
ACAGACGAAGAGGAAATCAAAGCCACTAACCCCGTGGCCACCGAAAGATTTGGGACCGTGGCAGTCAATC
TCCAGAGCAGCAGCACAGACCCTGCGACCGGAGATGTGCATGTTATGGGAGCCTTACCTGGAATGGTGTG
GCAAGACAGAGACGTATACCTGCAGGGTCCTATTTGGGCCAAAATTCCTCACACGGATGGACACTTTCAC
CCGTCTCCTCTCATGGGCGGCTTTGGACTTAAGCACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAACGCTGGAATCCCGAAGTGCAG
TATACATCTAACTATGCAAAATCTGCCAACGTTGATTTCACTGTGGACAACAATGGACTTTATACTGAGC
CTCGCCCCATTGGCACCCGTTACCTCACCCGTCCCCTGTAA

FIG. 3Q

M62 AMINO ACID SEQUENCE (SEQ ID NO:12)
MAADGYLPDWLEDNLSEGVREWWALQPGAPKPKANQQHQDNARGLVLPGYKYLGPGNGLDKGEPVNAADA
AALEHDKAYDQQLKAGDNPYLRYNHADAEFQERLQEDTSFGGNLGRAVFQAKKRVLEPLGLVEEGAKTAP
GKKRPVEQSPQEPDSSSGIGKKGQQPARKRLNFGQTGDSESVPDPQPLGEPPAAPSSVGSGTVAAGGGAP
MADNNEGADGVGNASGNWHCDSTWLGDRVITTSTRTWALPTYNNHLYKQISSASTGASNDNHYFGYSTPW
GYFDFNRFHCHFSPRDWQRLINNNWGFRPKRLNFKLFNIQVKEVTTNDGVTTIANNLTSTVQVFSDSEYQ
LPYVLGSAHQGCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLPGPCYRQQRVS
KTKTDNNSNFTWTGASKYNLNGRESIINPGTAMASHKDDEDKFFPMSGVMIFGKESAGASNTALDNVMI
TDEEEIKATNPVATERFGTVAVNLQSSSTDPATGDVHVMGALPGMVWQDRDVYLQGPIWAKIPHTDGHFH
PSPLMGGFGLKHPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3R

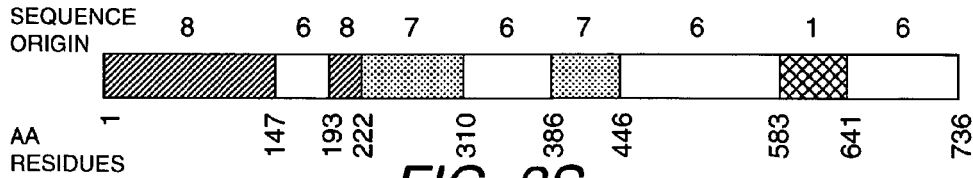

FIG. 3S

M67 CODING SEQUENCE (SEQ ID NO:13)
ATGGCTGCCGATGGTTATCTTCCAGATTGGCTCGAGGACAACCTCTCTGAGGGCATTCGCGAGTGGTGGG
CGCTGAAACCTGGAGCCCCGAAGCCCAAAGCCAACCAGCAAAAGCAGGACGACGGCCGGGGTCTGGTGCT
TCCTGGCTACAAGTACCTCGGACCCTTCAACGGACTCGACAAGGGGGAGCCCGTCAACGCGGCGGACGCA
GCGGCCCTCGAGCACGACAAGGCCTACGACCAGCAGCTGCAGGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGCGCTAAGACGGCTCCT
GGAAAGAAACGTCCGGTAGAGCAGTCGCCACAAGAGCCAGACTCCTCCTCGGGCATTGGCAAGACAGGCC
AACAGCCCGCCAGAAAAAGACTCAATTTTGGTCAGACTGGCGACTCAGAGTCAGTTCCAGACCCTCAACC
TCTCGGAGAACCTCCAGCAGCGCCCTCTGGTGTGGGACCTAATACAATGGCTGCAGGCGGTGGCGCACCA
ATGGCAGACAATAACGAAGGTGCCGACGGAGTGGGTAATGCCTCAGGAAATTGGCATTGCGATTCCACAT
GGCTGGGCGACAGAGTCATTACCACCAGCACCCGAACCTGGGCCCTGCCCACCTACAACAACCACCTCTA
CAAGCAAATCTCCAGTGAAACTGCGGGTAGTACCAACGACAACACCTACTTCGGCTACAGCACCCCCTGG
GGGTATTTTGACTTTAACAGATTCCACTGCCACTTCTCACCACGTGACTGGCAGCGACTCATCAACAACA
ATTGGGGATTCCGGCCCAAGAGACTCAACTTCAAACTCTTCAACATCCAAGTCAAGGAGGTCACGACGAA
TGATGGCGTCACAACCATCGCTAATAACCTTACCAGCACGGTTCAAGTCTTCTCGGACTCGGAGTACCAG
TTGCCGTACGTCCTCGGCTCTGCGCACCAGGGCTGCCTCCCTCCGTTCCCGGCGGACGTGTTCATGATTC
CGCAATACGGCTACCTGACGCTCAACAATGGCAGTCAGTCTGTGGGACGTTCCTCCTTCTACTGCCTGGA
GTACTTCCCCTCTCAGATGCTGAGAACGGGCAACAACTTTGAGTTCAGCTACACCTTCGAGGACGTGCCT
TTCCACAGCAGCTACGCGCACAGCCAGAGCCTGGACCGGCTGATGAATCCTCTCATCGACCAGTACCTGT
ATTACCTGAACAGAACTCAGAATCAGTCCGGAAGTGCCCAAAACAAGGACTTGCTGTTTAGCCGTGGGTC
TCCAGCTGGCATGTCTGTTCAGCCCAAAAACTGGCTACCTGGACCCTGTTATCGGCAGCAGCGCGTTTCT
AAAACAAAAACAGACAACAACAACAGCAATTTTACCTGGACTGGTGCTTCAAAATATAACCTCAATGGGC
GTGAATCCATCATCAACCCTGGCACTGCTATGGCCTCACACAAAGACGACAAAGACAAGTTCTTTCCCAT
GAGCGGTGTCATGATTTTTGGAAAGGAGAGCGCCGGAGCTTCAAACACTGCATTGGACAATGTCATGATC
ACAGACGAAGAGGAAATTAAAGCCACTAACCCCGTGGCCACCGAAAGATTTGGGACCGTGGCAGTCAATT
TCCAGAGCAGCAGCACAGACCCTGCGACCGGAGATGTGCATGCTATGGGAGCATTACCTGGCATGGTGTG
GCAAGATAGAGCGTGTACCTGCAGGGTCCCATTTGGGCCAAAATTCCTCACACAGATGGACACTTTCAC
CCGTCTCCTCTCATGGGCGGCTTTGGACTTAAGCACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAGCGCTGGAATCCCGAAGTGCAG
TACACATCCAATTATGCAAAATCTGCCAACGTTGATTTTACTGTGGACAACAATGGACTTTATACTGAGC
CTCGCCCCATTGGCACCCGTTACCTTACCCGTCCCCTGTAA

FIG. 3T

M67 AMINO ACID SEQUENCE (SEQ ID NO:14)
MAADGYLPDWLEDNLSEGIREWWALKPGAPKPKANQQKQDDGRGLVLPGYKYLGPFNGLDKGEPVNAADA
AALEHDKAYDQQLQAGDNPYLRYNHADAEFQERLQEDTSFGGNLGRAVFQAKKRVLEPLGLVEEGAKTAP
GKKRPVEQSPQEPDSSSGIGKTGQQPARKRLNFGQTGDSESVPDPQPLGEPPAAPSGVGPNTMAAGGGAP
MADNNEGADGVGNASGNWHCDSTWLGDRVITTSTRTWALPTYNNHLYKQISSETAGSTNDNTYFGYSTPW
GYFDFNRFHCHFSPRDWQRLINNNWGFRPKRLNFKLFNIQVKEVTTNDGVTTIANNLTSTVQVFSDSEYQ
LPYVLGSAHQGCLPPFPADVFMIPQYGYLTLNNGSQSVGRSSFYCLEYFPSQMLRTGNNFEFSYTFEDVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNFQSSSTDPATGDVHAMGALPGMVWQDRDVYLQGPIWAKIPHTDGHFH
PSPLMGGFGLKHPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3U

PHYLOGENETIC ORIGIN OF M125 AAV CAPSID GENE

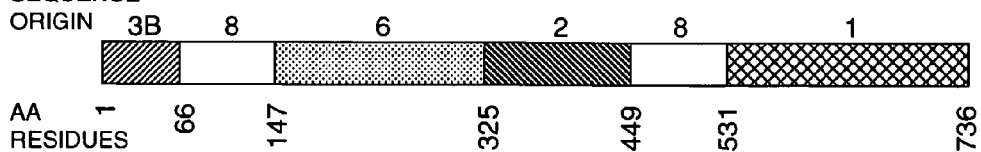

FIG. 3V

M125 CODING SEQUENCE (SEQ ID NO:15)
ATGGCTGCCGATGGTTATCTTCCAGATTGGCTCGAGGACAACCTTTCTGAAGGCATTCGTGAGTGGTGGG
CTCTGAAACCTGGAGTCCCTCAACCCAAAGCGAACCAACAACACCAGGACAACCGTCGGGGTCTTGTGCT
TCCGGGTTACAAATACCTCGGACCCGGTAACGGACTCGACAAAGGAGAGCCCGTCAACGCGGCGGACGCA
GCGGCCCTGGAGCACGACAAGGCCTACGACCAGCAGCTGCAGGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGCGCTAAGACGGCTCCT
GGAAAGAAACGTCCGGTAGAGCAGTCGCCACAAGAGCCAGACTCCTCCTCGGGCATTGGCAAGACAGGCC
AGCAGCCCGCTAAAAAGAGACTCAATTTTGGTCAGACTGGCGACTCAGAGTCAGTCCCCGATCCACAACC
TCTCGGAGAACCTCCAGCAACCCCCGCTGCTGTGGGACCTACTACAATGGCTTCAGGCGGTGGCGCACCA
ATGGCAGACAATAACGAAGGCGCCGACGGAGTGGGTAATGCCTCAGGAAATTGGCATTGCGATTCCACAT
GGCTGGGCGACAGAGTCATCACCACCAGCACCCGAACATGGGCCTTGCCCACCTATAACAACCACCTCTA
CAAGCAAATCTCCAGTGCTTCAACGGGGGCCAGCAACGACAACCACTACTTCGGCTACAGCACCCCCTGG
GGGTATTTTGATTTCAACAGATTCCACTGCCACTTTTCACCACGTGACTGGCAGCGACTCATCAACAACA
ATTGGGGATTCCGGCCCAAGAGACTCAACTTCAAGCTCTTCAACATCCAAGTTAAAGAGGTCACGCAGAA
CGATGGCACGACGACTATTGCCAATAACCTTACCAGCACGGTTCAAGTGTTTACGGACTCGGAGTACCAG
TTGCCGTACGTCCTCGGCTCTGCGCACCAGGGCTGCCTCCCTCCGTTCCCGGCGGACGTGTTCATGATTC
CGCAGTACGGCTACCTAACGCTCAACAATGGCAGCCAGGCAGTGGGACGGTCATCCTTTTACTGCCTGGA
ATATTTCCCATCGCAGATGCTGAGAACGGGCAATAACTTTACCTTCAGCTACACCTTCGAGGACGTGCCT
TTCCACAGCAGCTACGCGCACAGCCAGAGCCTGGACCGGCTGATGAATCCTCTGATTGACCAGTACCTGT
ACTACTTGTCTCGGACTCAAACAACAGGAGGCACGGCAAATACGCAGACTCTGGGCTTCAGCCAAGGTGG
GCCTAATACAATGGCCAATCAGGCAAAGAACTGGCTGCCAGGACCCTGTTACCGCCAACAACGCGTCTCA
ACGACAACCGGGCAAAACAACAATAGCAACTTTGCCTGGACTGCTGGGACCAAATACCATCTGAATGGAA
GAAATTCATTGGCTAATCCTGGCATCGCTATGGCAACACACAAAGACGACGAAGACAAGTTCTTTCCCAT
GAGCGGTGTCATGATTTTTGGAAAGGAGAGCGCCGGAGCTTCAAACACTGCATTGGACAATGTCATGATT
ACAGACGAAGAGGAAATTAAAGCCACTAACCCTGTGGCCACCGAAAGATTTGGGACCGTGGCAGTCAATT
TCCAGAGCAGCAGCACAGACCCTGCGACCGGAGATGTGCATGCTATGGGAGCATTACCTGGCATGGTGTG
GCAAGATAGAGACGTGTACCTGCAGGGTCCCATTTGGGCCAAAATTCCTCACACAGATGGACACTTTCAC
CCGTCTCCTCTTATGGGCGGCTTTGGACTCAAGAACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAACGCTGGAATCCCGAAGTGCAG
TATACATCTAACTATGCAAAATCTGCCAACGTTGATTTCACTGTGGACAACAATGGACTTTATACTGAGC
CTCGCCCCATTGGCACCCGTTACCTCACCCGTCCCCTGTAA

FIG. 3W

M125 AMINO ACID SEQUENCE (SEQ ID NO:16)
MAADGYLPDWLEDNLSEGIREWWALKPGVPQPKANQQHQDNRRGLVLPGYKYLGPGNGLDKGEPVNAADA
AALEHDKAYDQQLQAGDNPYLRYNHADAEFQERLQEDTSFGGNLGRAVFQAKKRVLEPLGLVEEGAKTAP
GKKRPVEQSPQEPDSSSGIGKTGQQPAKKRLNFGQTGDSESVPDPQPLGEPPATPAAVGPTTMASGGGAP
MADNNEGADGVGNASGNWHCDSTWLGDRVITTSTRTWALPTYNNHLYKQISSASTGASNDNHYFGYSTPW
GYFDFNRFHCHFSPRDWQRLINNNWGFRPKRLNFKLFNIQVKEVTQNDGTTTIANNLTSTVQVFTDSEYQ
LPYVLGSAHQGCLPPFPADVFMIPQYGYLTLNNGSQAVGRSSFYCLEYFPSQMLRTGNNFTFSYTFEDVP
FHSSYAHSQSLDRLMNPLIDQYLYYLSRTQTTGGTANTQTLGFSQGGPNTMANQAKNWLPGPCYRQQRVS
TTTGQNNNSNFAWTAGTKYHLNGRNSLANPGIAMATHKDDEDKFFPMSGVMIFGKESAGASNTALDNVMI
TDEEEIKATNPVATERFGTVAVNFQSSSTDPATGDVHAMGALPGMVWQDRDVYLQGPIWAKIPHTDGHFH
PSPLMGGFGLKNPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3X

PHYLOGENETIC ORIGIN OF M148 AAV CAPSID GENE

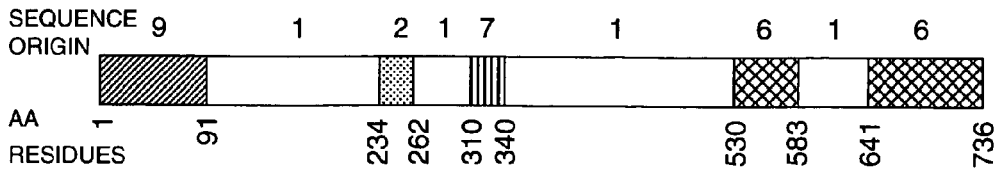

FIG. 3Y

M148 CODING SEQUENCE (SEQ ID NO:17)
ATGGCTGCCGATGGTTATCTTCCAGATTGGCTCGAGGACAACCTCTCTGAGGGCATTCGCGAGTGGTGGG
ACTTGAAACCTGGAGCCCCTCAACCCAAGGCAAATCAACAACATCAAGACAACGCTCGAGGTCTGGTGCT
TCCGGGTTACAAATACCTTGGACCCGGCAACGGACTCGACAAGGGGGAGCCGGTCAACGCAGCAGACGCG
GCGGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGTGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCTAAAAAGAGACTCAATTTTGGTCAGACTGGCGACTCAGAGTCAGTCCCCGATCCACAACC
TCTCGGAGAACCTCCAGCAACCCCCGCTGCTGTGGGACCTACTACAATGGCTTCAGGCGGTGGCGCACCA
ATGGCAGACAATAACGAAGGCGCCGACGGAGTGGGTAATGCCTCAGGAAATTGGCATTGCGATTCCACAT
GGATGGGCGACAGAGTCATCACCACCAGCACCCGCACCTGGGCCTTGCCCACCTACAATAACCACCTCTA
CAAGCAAATCTCCAGTGCTTCAACGGGGGCCAGCAACGACAACCACTACTTCGGCTACAGCACCCCCTGG
GGGTATTTTGATTTCAACAGATTCCACTGCCATTTCTCACCACGTGACTGGCAGCGACTCATCAACAACA
ACTGGGGATTCCGGCCCAAGAAGCTGCGGTTCAAGCTCTTCAACATCCAAGTCAAGGAGGTCACGACGAA
TGATGGCGTCACGACCATCGCTAATAACCTTACCAGCACGGTTCAAGTCTTCTCGGACTCGGAGTACCAG
CTTCCGTACGTCCTCGGCTCTGCGCACCAGGGCTGCCTCCCTCCGTTCCCGGCGGACGTGTTCATGATTC
CGCAATACGGCTACCTGACGCTCAACAATGGCAGCCAAGCCGTGGGACGTTCATCCTTTTACTGCCTGGA
ATATTTCCCATCGCAGATGCTGAGAACGGGCAACAACTTTACCTTCAGCTACACCTTTGAGGAAGTGCCT
TTCCACAGCAGCTACGCGCACAGCCAGAGCCTGGACCGGCTGATGAATCCTCTCATCGACCAATACCTGT
ATTACCTGAACAGAACTCAAAATCAGTCCGGAAGTGCCCAAAACAAGGACTTGCTGTTTAGCCGGGGGTC
TCCAGCTGGCATGTCTGTTCAGCCCAAAAACTGGCTACCTGGACCCTGTTACCGGCCAGCAGCCGCGTTTCT
AAAACAAAACAGACAACAACAACAGCAACTTTACCTGGACTGGTGCTTCAAAATATAACCTTAATGGGC
GTGAATCTATAATCAACCCTGGCACTGCTATGGCCTCACACAAAGACGAAAAAGACAAGTTCTTTCCCAT
GAGCGGTGTCATGATTTTTGGAAAAGAGAGCGCCGGAGCTTCAAACACTGCATTGGACAATGTCATGATT
ACAGACGAAGAGGAAATTAAAGCCACTAACCCTGTGGCCACCGAAAGATTTGGGACCGTGGCAGTCAATT
TCCAGAGCAGCAGCACAGACCCTGCGACCGGAGATGTGCATGCTATGGGAGCATTACCTGGCATGGTGTG
GCAAGATAGAGACGTGTACCTGCAGGGTCCTATTTGGGCCAAAATTCCTCACACGGATGGACACTTTCAC
CCGTCTCCTCTCATGGGCGGCTTTGGACTTAAGCACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAACGCTGGAATCCCGAAGTGCAG
TATACATCTAACTATGCAAAATCTGCCAACGTTGATTTCACTGTGGACAACAATGGACTTTATACTGAGC
CTCGCCCCATTGGCACCCGTTACCTCACCCGTCCCCTGTAA

FIG. 3Z

M148 AMINO ACID SEQUENCE (SEQ ID NO:18)
MAADGYLPDWLEDNLSEGIREWWDLKPGAPQPKANQQHQDNARGLVLPGYKYLGPGNGLDKGEPVNAADA
AALEHDKAYDQQLKAGDNPYLRYNHADAEFQERLQEDTSFGGNLGRAVFQAKKRVLEPLGLVEEGAKTAP
GKKRPVEQSPQEPDSSSGIGKTGQQPAKKRLNFGQTGDSESVPDPQPLGEPPATPAAVGPTTMASGGGAP
MADNNEGADVGNASGNWHCDSTWMGDRVITTSTRTWALPTYNNHLYKQISSASTGASNDNHYFGYSTPW
GYFDFNRFHCHFSPRDWQRLINNNWGFRPKKLRFKLFNIQVKEVTTNDGVTTIANNLTSTVQVFSDSEYQ
LPYVLGSAHQGCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDEKDKFFPMSGVMIFGKESAGASNTALDNVMI
TDEEEIKATNPVATERFGTVAVNFQSSSTDPATGDVHAMGALPGMVWQDRDVYLQGPIWAKIPHTDGHFH
PSPLMGGFGLKHPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3AA

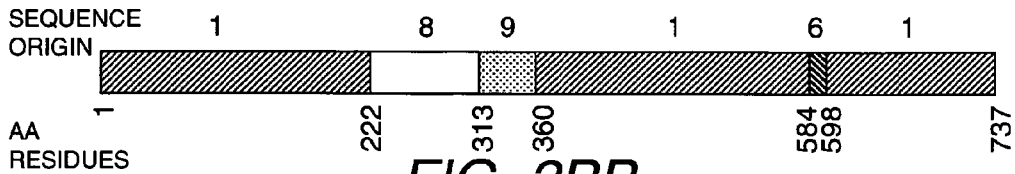

FIG. 3BB

M151 CODING SEQUENCE (SEQ ID NO:19)
ATGGCTGCCGATGGTTATCTTCCAGATTGGCTCGAGGACAACCTCTCTGAGGGCATTCGCGAGTGGTGGG
ACCTGAAACCTGGAGCCCCGAAACCCAAAGCGAACCAACAACACCAGGACAACCGTCGGGGTCTTGTGCT
TCCGGGTTACAAATACCTCGGACCCGGTAACGGACTCGACAAGGGGGAGCCCGTCAACGCGGCGGATGCA
GCGGCCCTCGAGCACGACAAGGCCTACGACCAGCAGCTCAAAGCGGGTGACAATCCGTACCTGCGGTATA
ACCACGCGACGCCGAGTTTCAGGAGCGTCTGCAAGAAGATACGTCTTTTGGGGGCAACCTCGGGCGAGC
AGTCTTCCAGGCCAAAAAGAGGGTTCTCGAACCTCTCGGTCTGGTTGAGGAAGGCGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCTAAAAAGAGACTCAATTTTGGTCAGACTGGCGACTCAGAGTCAGTCCCCGACCCACAACC
TCTCGGAGAACCTCCAGCAACCCCCGCTGCTGTGGGACCTACTACAATGGCTTCAGGCGGTGGCGCACCA
ATGGCAGACAATAACGAAGGCGCCGACGGAGTGGGTAGTTCCTCGGGAAATTGGCATTGCGATTCCACAT
GGCTGGGCGACAGAGTCATCACCACCAGCACCCGAACCTGGGCCCTGCCCACCTACAACAACCACCTCTA
CAAGCAAATCTCCAACGGGACATCGGGAGGAGCCACCAACGACAACACCTACTTCGGCTACAGCACCCCC
TGGGGGTATTTTGACTTTAACAGATTCCACTGCCACTTTTCACCACGTGACTGGCAGCGACTCATCAACA
ACAACTGGGGATTCCGGCCTAAGCGACTCAACTTCAAGCTCTTCAACATTCAGGTCAAAGAGGTTACGGA
CAACAATGGAGTCAAGACCATCGCCAATAACCTTACCAGCACGGTCCAGGTCTTCACGGACTCAGACTAT
CAGCTCCCGTACGTCCTCGGCTCTGCGCACCAGGGCTGCCTCCCTCCGTTCCCGGCGGACGTGTTCATGA
TTCCGCAATACGGCTACCTAACGCTCAACAATGGCAGCCAGGCAGTGGGACGGTCATCCTTTTACTGCCT
GGAATATTTCCCATCGCAGATGCTGAGAACGGGCAATAACTTTACCTTCAGCTACACCTTCGAGGACGTG
CCTTTCCACAGCAGCTACGCGCACAGCCAGAGCCTGGACCGGCTGATGAATCCTCTCATCGACCAGTACC
TGTATTACCTGAACAGAACTCAAAATCAGTCCGGAAGTGCCCAAAACAAGGACTTGCTGTTTAGCCGTGG
GTCTCCAGCTGGCATGTCTGTTCAGCCCAAAAACTGGCTACCTGGACCCTGTTATCGGCAGCAGCGCGTT
TCTAAAACAAAAACAGACAACAACAACAGCAATTTTACCTGGACTGGTGCTTCAAAATATAACCTCAATG
GGCGTGAATCCATCATCAACCCTGGCACTGCTATGGCCTCACACAAAGACGACGAAGACAAGTTCTTTCC
CATGAGCGGTGTCATGATTTTTGGAAAGGAGAGCGCCGGAGCTTCAAACACTGCATTGGACAATGTCATG
ATCACAGACGAAGAGGAAATCAAAGCCACTAACCCCGTGGCCACCGAAAGATTTGGGACTGTGGCAGTCA
ATCTCCAGAGCAGCAGCACAGACCCTGCGACCGGAGATGTGCATGCTATGGGAGCATTACCTGGCATGGT
GTGGCAAGATAGAGACGTGTACCTGCAGGGTCCCATTTGGGCCAAAATTCCTCACACAGATGGACACTTT
CACCCGTCTCCTCTTATGGGCGGCTTTGGACTCAAGAACCCGCCTCCTCAGATCCTCATCAAAAACACGC
CTGTTCCTGCGAATCCTCCGGCAGAGTTTTCGGCTACAAAGTTTGCTTCATTCATCACCCAGTATTCCAC
AGGACAAGTGAGCGTGGAGATTGAATGGAGCTGCAGAAAGAAAACAGCAAACGCTGGAATCCCGAAGTG
CAGTACACATCCAATTATGCAAAATCTGCCAACGTTGATTTTACTGTGGACAACAATGGACTTTATACTG
AGCCTCGCCCCATTGGCACCCGTTACCTTACCCGTCCCCTGTAA

FIG. 3CC

M151 AMINO ACID SEQUENCE (SEQ ID NO:20)
MAADGYLPDWLEDNLSEGIREWWDLKPGAPKPKANQQHQDNRRGLVLPGYKYLGPGNGLDKGEPVNAADA
AALEHDKAYDQQLKAGDNPYLRYNHADAEFQERLQEDTSFGGNLGRAVFQAKKRVLEPLGLVEEGAKTAP
GKKRPVEQSPQEPDSSSGIGKTGQQPAKKRLNFGQTGDSESVPDPQPLGEPPATPAAVGPTTMASGGAP
MADNNEGADGVGSSSGNWHCDSTWLGDRVITTSTRTWALPTYNNHLYKQISNGTSGGATNDNTYFGYSTP
WGYFDFNRFHCHFSPRDWQRLINNNWGFRPKRLNFKLFNIQVKEVTDNNGVKTIANNLTSTVQVFTDSDY
QLPYVLGSAHQGCLPPFPADVFMIPQYGYLTLNNGSQAVGRSSFYCLEYFPSQMLRTGNNFTFSYTFEDV
PFHSSYAHSQSLDRLMNPLIDQYLYYLNRTQNQSGSAQNKDLLFSRGSPAGMSVQPKNWLPGPCYRQQRV
SKTKTDNNNSNFTWTGASKYNLNGRESIINPGTAMASHKDDEDKFFPMSGVMIFGKESAGASNTALDNVM
ITDEEEIKATNPVATERFGTVAVNLQSSSTDPATGDVHAMGALPGMVWQDRDVYLQGPIWAKIPHTDGHF
HPSPLMGGFGLKNPPPQILIKNTPVPANPPAEFSATKFASFITQYSTGQVSVEIEWELQKENSKRWNPEV
QYTSNYAKSANVDFTVDNNGLYTEPRPIGTRYLTRPL

FIG. 3DD

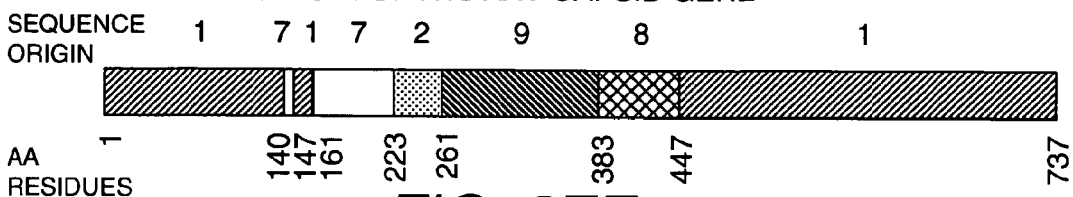

PHYLOGENETIC ORIGIN OF H18 AAV CAPSID GENE

FIG. 3EE

H18 CODING SEQUENCE (SEQ ID NO:21)
```
ATGGCTGCCGATGGTTATCTTCCAGATTGGCTCGAGGACAACCTCTCTGAGGGCATTCGCGAGTGGTGGG
CGCTGAAACCTGGAGCCCCGAAGCCCAAAGCCAACCAGCAAAAGCAGGACGACGGCCGGGGTCTGGTGCT
TCCTGGCTACAAGTACCTCGGACCCTTCAACGGACTCGACAAGGGGGAGCCCGTCAACGCGGCGGACGCA
GCGGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGAGGGTTCTCGAACCTCTCGGTCTGGTTGAGGAAGGCGCTAAGACGGCTCCT
GCAAAGAAACGTCCGGTAGAGCAGTCGCCACAAGAGCCAGACTCCTCCTCGGGCATCGGCAAGAAGGCC
AACAGCCCGCCAGAAAAAGACTCAATTTTGGTCAGACTGGCGACTCAGAGTCAGTTCCAGACCCTCAACC
TCTCGGAGAACCTCCAGCAGCGCCCTCTAGTGTGGGATCTGGTACAGTGGCTGCAGGCGGTGGCGCACCA
ATGGCAGACAATAACGAGGGCGCCGACGGAGTGGGTAATTCCTCGGGAAATTGGCATTGCGATTCCACAT
GGATGGGCGACAGAGTCATCACCACCAGCACCCGAACCTGGGCCCTGCCCACCTACAACAATCACCTCTA
CAAGCAAATCTCCAACAGCACATCTGGAGGATCTTCAAATGACAACGCCTACTTCGGCTACAGCACCCCC
TGGGGGTATTTTGATTTCAACAGATTCCACTGCCACTTTTCACCACGTGACTGGCAGCGACTCATCAACA
ACAACTGGGGATTCCGGCCTAAGCGACTCAACTTCAAGCTCTTCAACATTCAGGTCAAAGAGGTTACGGA
CAACAATGGAGTCAAGACCATCGCCAATAACCTTACCAGCACGGTCCAGGTCTTCACGGACTCAGACTAT
CAGCTCCCGTACGTGCTCGGGTCGGCTCACGAGGGCTGCCTCCCGCCGTTCCCAGCGGACGTCTTCATGG
TGCCACAGTATGGATACCTCACCCTGAACAACGGGAGTCAGGCAGTGGGACGCTCTTCATTTTACTGCCT
GGAGTACTTTCCTTCGCAGATGCTGAGAACCGGCAACAACTTCCAGTTTACTTACACCTTCGAGGACGTG
CCTTTCCACAGCAGCTACGCGCACAGCCAGAGCCTGGACCGTCTCATGAATCCTCTCATCGACCAGTACC
TGTATTACCTGAACAGAACTCAGAATCAGTCCGGAAGTGCCCAAAACAAGGACTTGCTGTTTAGCCGGGG
GTCTCCAGCTGGCATGTCTGTTCAGCCCAAAAACTGGCTACCTGGACCCTGTTACCGGCAGCAGCGCGTT
TCTAAAACAAAAACAGACAACAACAACAGCAATTTTACCTGGACTGGTGCTTCAAAATATAACCTTAATG
GGCGTGAATCTATAATCAACCCTGGCACTGCTATGGCCTCACACAAAGACGACGAAGACAAGTTCTTTCC
CATGAGCGGTGTCATGATTTTTGGAAAGGAGAGCGCCGGAGCTTCAAACACTGCATTGGACAATGTCATG
ATCACAGACGAAGAGGAAATCAAAGCCACTAACCCTGTGGCCACCGAAAGATTTGGGACCGTGACAGTCA
ATTTCCAGAGCAGCAGCACAGACCCTGCGACCGGAGATGTGCATGCTATGGGAGCATTACCTGGCATGGT
GTGGCAAGATAGAGACGTGTACCTGCAGGGTCCCATTTGGGCCAAAATTCCTCACACAGATGGACACTTT
CACCCGTCTCCTCTTATGGGCGGCTTTGGACTCAAGAACCCGCCTCCTCAGATCCTCATCAAAAACACGC
CTGTTCCTGCGAATCCTCCGGCGGAGTTTTCAGCTACAAAGTTTGCTTCATTCATCACCCAATACTCCAC
AGGACAAGTGAGTGTGGAAATTGAATGGGAACTGCAGAAAGAAAACAGCAAGCGCTGGAATCCCGAAGTG
CAGTACACATCCAATTATGCAAAATCTGCCAACGTTGATTTTACTGTGGACAACAATGGACTTTATACTG
AGCCTCGCCCCATTGGCACCCGTTACCTCACCCGTCCCCTGTAAC
```

FIG. 3FF

H18 AMINO ACID SEQUENCE (SEQ ID NO:22)
```
MAADGYLPDWLEDNLSEGIREWWALKPGAPKPKANQQKQDDGRGLVLPGYKYLGPFNGLDKGEPVNAADA
AALEHDKAYDQQLKAGDNPYLRYNHADAEFQERLQEDTSFGGNLGRAVFQAKKRVLEPLGLVEEGAKTAP
AKKRPVEQSPQEPDSSSGIGKKGQQPARKRLNFGQTGDSESVPDPQPLGEPPAAPSSVGSGTVAAGGGAP
MADNNEGADGVGNSSGNWHCDSTWMGDRVITTSTRTWALPTYNNHLYKQISNSTSGGSSNDNAYFGYSTP
WGYFDFNRFHCHFSPRDWQRLINNNWGFRPKRLNFKLFNIQVKEVTDNNGVKTIANNLTSTVQVFTDSDY
QLPYVLGSAHEGCLPPFPADVFMVPQYGYLTLNNGSQAVGRSSFYCLEYFPSQMLRTGNNFQFTYTFEDV
PFHSSYAHSQSLDRLMNPLIDQYLYYLNRTQNQSGSAQNKDLLFSRGSPAGMSVQPKNWLPGPCYRQQRV
SKTKTDNNNSNFTWTGASKYNLNGRESIINPGTAMASHKDDEDKFFPMSGVMIFGKESAGASNTALDNVM
ITDEEEIKATNPVATERFGTVTVNFQSSSTDPATGDVHAMGALPGMVWQDRDVYLQGPIWAKIPHTDGHF
HPSPLMGGFGLKNPPPQILIKNTPVPANPPAEFSATKFASFITQYSTGQVSVEIEWELQKENSKRWNPEV
QYTSNYAKSANVDFTVDNNGLYTEPRPIGTRYLTRPL
```

FIG. 3GG

PHYLOGENETIC ORIGIN OF H34 AAV CAPSID GENE

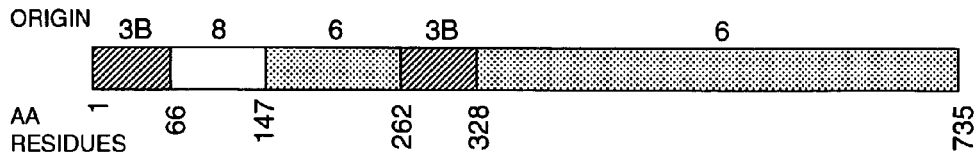

FIG. 3HH

H34 CODING SEQUENCE (SEQ ID NO:23)
ATGGCTGCCGATGGTTATCTTCCAGATTGGCTCGAGGACAACCTTTCTGAAGGCATTCGTGAGTGGTGGG
CTCTGAAACCTGGAGTCCCTCAACCCAAAGCGAACCAACAACACCAGGACAACCGTCGGGGTCTTGTGCT
TCCGGGTTACAAATACCTCGGACCCGGTAACGGACTCGACAAGGGGGAGCCCGTCAACGCGGCGGACGCA
GCGGCCCTGGAGCACGACAAGGCCTACGACCAGCAGCTGCAGGCGGGTGACAATCCGTACCTGCGGTATA
ACCACGCCGACGCCGAGTTTCAGGAGCGTCTGCAAGAAGATACGTCTTTTGGGGGCAACCTCGGCGAGC
AGTCTTCCAGGCCAAGAAGCGGGTTCTCGAACCTCTCGGTCTGGTTGAGGAAGGCGCTAAGACGGCTCCT
GGAAAGAAACGTCCGGTAGAGCAGTCGCCACAAGAGCCAGACTCCTCCTCGGGCATTGGCAAGACAGGCC
AGCAGCCCGCTAAAAAGAGACTCAATTTTGGTCAGACTGGCGACTCAGAGTCAGTCCCCGACCCTCAACC
TCTCGGAGAACCTCCAGCAACCCCCGCTGCTGTGGGACCTACTACAATGGCTACAGGCAGTGGCGCACCC
ATGGCAGACAATAACGAGGGTGCCGACCGAGTGGGTAATGCCTCACGAAATTGGCATTGCGATTCCACAT
GGCTGGGCGACAGAGTCATCACCACCACCACCCGAACATGGGCCTTGCCCACCTATAACAACCACCTCTA
CTATCAAATTTCCAGCCAATCAGGAGCCTCGAACGACAATCACTACTTCGGCTACAGCACCCCCTGGGGG
TATTTGACTTTAACAGATTCCACTGCCACTTTTCACCACGTGACTGGCAGCGACTCATCAACAACAACT
GGGGATTCCGGCCCAAGAGACTCAGCTTCAAGCTCTTCAACATCCAGGTCAAGGAGGTCACGCAGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGAATGGTGTGGCA
AGACAGAGACGTGTACCTGCAGGGTCCCATTTGGGCCAAAATTCCTCACACAGATGGACACTTTCACCCG
TCTCCTCTTATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTTACCCGTCCCCTGTAA

FIG. 3II

H34 AMINO ACID SEQUENCE (SEQ ID NO:24)
MAADGYLPDWLEDNLSEGIREWWALKPGVPQPKANQQHQDNRRGLVLPGYKYLGPGNGLDKGEPVNAADA
AALEHDKAYDQQLQAGDNPYLRYNHADAEFQERLQEDTSFGGNLGRAVFQAKKRVLEPLGLVEEGAKTAP
GKKRPVEQSPQEPDSSSGIGKTGQQPAKKRLNFGQTGDSESVPDPQPLGEPPATPAAVGPTTMATGSGAP
MADNNEGADRVGNASRNWHCDSTWLGDRVITTTTRTWALPTYNNHLYYQISSQSGASNDNHYFGYSTPWG
YFDFNRFHCHFSPRDWQRLINNNWGFRPKRLSFKLFNIQVKEVTQNDGVTTIANNLTSTVQVFSDSEYQL
PYVLGSAHQGCLPPFPADVFMIPQYGYLTLNNGSQAVGRSSFYCLEYFPSQMLRTGNNFTFSYTFEDVPF
HSSYAHSQSLDRLMNPLIDQYLYYLNRTQNQSGSAQNKDLLFSRGSPAGMSVQPKNWLPGPCYRQQRVSK
TKTDNNNSNFTWTGASKYNLNGRESIINPGTAMASHKDDKDKFFPMSGVMIFGKESAGASNTALDNVMIT
DEEEIKATNPVATERFGTVAVNLQSSSTDPATGDVHVMGALPGMVWQDRDVYLQGPIWAKIPHTDGHFHP
SPLMGGFGLKHPPPQILIKNTPVPANPPAEFSATKFASFITQYSTGQVSVEIEWELQKENSKRWNPEVQY
TSNYAKSANVDFTVDNNGLYTEPRPIGTRYLTRPL

FIG. 3JJ

PHYLOGENETIC ORIGIN OF H39 AAV CAPSID GENE

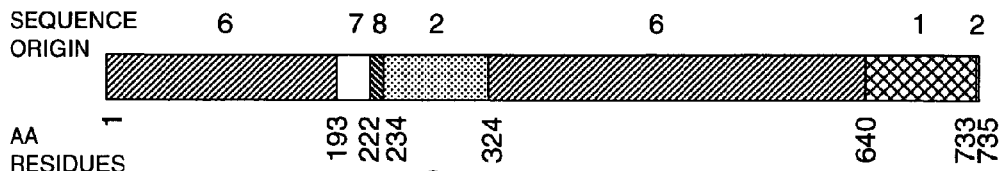

FIG. 3KK

H39 CODING SEQUENCE (SEQ ID NO:25)
ATGGCTGCCGATGGTTATCTTCCAGATTGGCTCGAGGACAACCTCTCTGAGGGCATTCGCGAGTGGTGGG
ACTTGAAACCTGGAGCCCCGAAGCCCAAAGCCAACCAGCAAAAGCAGGACGACGGCCGGGGTCTGGTGCT
TCCTGGCTACAAGTACCTCGGACCCTTCAACGGACTCGACAAGGGGGAGCCCGTCAACGCGGCGGACGCA
GCGGCCTTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGAGGGTTCTCGAACCTTTTGGTCTGGTTGAGGAAGGTGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCCAGAAAGAGACTCAATTTCGGTCAGACTGGCGACTCAGAGTCAGTCCCCGACCCTCAACC
TCTCGGAGAACCTCCAGCAGCGCCCTCTAGTGTGGGATCTGGTACAGTGGCTGCAGGTGGTGGCGCACCA
GTGGCAGACAATAACGAAGGCGCCGACGGAGTGGGTAGTTCCTCGGGAAATTGGCATTGCGATTCCACAT
GGATGGGCGACAGAGTCATCACCACCAGCACCCGAACCTGGGCCCTGCCCACCTACAACAACCACCTCTA
CAAACAAATTTCCAGCCAATCAGGAGCCTCGAACGACAATCACTACTTTGGCTACAGCACCCCTTGGGGG
TATTTTGACTTCAACAGATTCCACTGCCACTTTTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGAATGGTGTGGCA
AGACAGAGACGTGTACCTGCAGGGTCCCATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCGGAGTTTTCAGCTACAAAGTTTGCTTCATTCATCACCCAATACTCCACAGGACA
AGTGAGTGTGGAAATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTAATCTGTAA

FIG. 3LL

H39 AMINO ACID SEQUENCE (SEQ ID NO:26)
MAADGYLPDWLEDNLSEGIREWWDLKPGAPKPKANQQKQDDGRGLVLPGYKYLGPFNGLDKGEPVNAADA
AAFEHDKAYDQQLKAGDNPYLRYNHADAEFQERLQEDTSFGGNLGRAVFQAKKRVLEPFGLVEEGAKTAP
GKKRPVEQSPQEPDSSSGIGKTGQQPARKRLNFGQTGDSESVPDPQPLGEPPAAPSSVGSGTVAAGGGAP
VADNNEGADGVGSSSGNWHCDSTWMGDRVITTSTRTWALPTYNNHLYKQISSQSGASNDNHYFGYSTPWG
YFDFNRFHCHFSPRDWQRLINNNWGFRPKRLNFKLFNIQVKEVTTNDGVTTIANNLTSTVQVFSDSEYQL
PYVLGSAHQGCLPPFPADVFMIPQYGYLTLNNGSQAVGRSSFYCLEYFPSQMLRTGNNFTFSYTFEEVPF
HSSYAHSQSLDRLMNPLIDQYLYYLNRTQNQSGSAQNKDLLFSRGSPAGMSVQPKNWLPGPCYRQQRVSK
TKTDNNNSNFTWTGASKYNLNGRESIINPGTAMASHKDKDKFFPMSGVMIFGKESAGASNTALDNVMIT
DEEEIKATNPVATERFGTVAVNLQSSSTDPATGDVHVMGALPGMVWQDRDVYLQGPIWAKIPHTDGHFHP
SPLMGGFGLKNPPPQILIKNTPVPANPPAEFSATKFASFITQYSTGQVSVEIEWELQKENSKRWNPEVQY
TSNYAKSANVDFTVDNNGLYTEPRPIGTRYLTRNL

FIG. 3MM

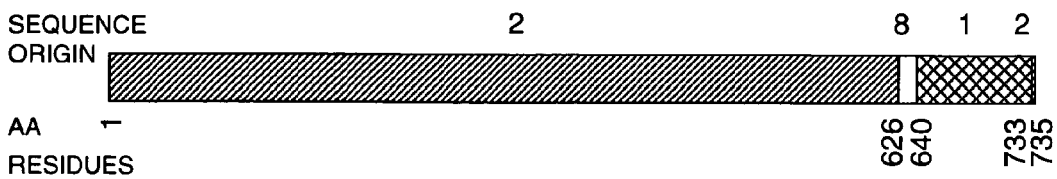

FIG. 3NN

H40 CODING SEQUENCE (SEQ ID NO:27)
ATGGCTGCCGATGGTTATCTTCCAGATTGGCTCGAGGACACTCTCTCTGAAGGAATAAGACAGTGGTGGA
AGCTCAAACCTGGCCCACCACCACCAAAGCCCGCAGAGCGGCATAAGGACGACAGCAGGGGTCTTGTGCT
TCCTGGGTACAAGTACCTCGGACCCTTCAACGGACTCGACAAGGGAGAGCCGGTCAACGAGGCAGACGCC
GCGGCCCTCGAGCACGACAAAGCCTACGACCGGCAGCTCGACAGCGGAGACAACCCGTACCTCAAGTACA
ACCACGCCGACGCGGAGTTTCAGGAGCGCCTTAAAGAAGATACGTCTTTTGGGGGCAACCTCGGACGAGC
AGTCTTCCAGGCGAAAAAGAGGGTTCTTGAACCTCTGGGCCTGGTTGAGGAACCTGTTAAGACGGCTCCG
GGAAAAAAGAGGCCGGTAGAGCACTCTCCTGTGGAGCCAGACTCCTCCTCGGGAACCGGAAAGGCGGGCC
AGCAGCCTGCAAGAAAAGATTGAATTTTGGTCAGACTGGAGACGCAGACTCAGTACCTGACCCCCAGCC
TCTCGGACAGCCACCAGCAGCCCCCTCTGGTCTGGGAACTAATACGATGGCTACAGGCAGTGGCGCACCA
ATGGCAGACAATAACGAGGGCGCCGACGGAGTGGGTAATTCCTCGGGAAATTGGCATTGCGATTCCACAT
GGATGGGCGACAGAGTCATCACCACCAGCACCCGAACCTGGGCCCTGCCCACCTACAACAACCACCTCTA
CAAACAAATTTCCAGCCAATCAGGAGCCTCGAACGACAATCACTACTTTGGCTACAGCACCCCTTGGGGG
TATTTTGACTTCAACAGATTCCACTGCCACTTTTCACCACGTGACTGGCAAAGACTCATCAACAACAACT
GGGGATTCCGACCCAAGAGACTCAACTTCAAGCTCTTTAACATTCAAGTCAAAGAGGTCACGCAGAATGA
CGGTACGACGACGATTGCCAATAACCTTACCAGCACGGTTCAGGTGTTTACTGACTCGGAGTACCAGCTC
CCGTACGTCCTCGGCTCGGCGCATCAAGGATGCCTCCCGCCGTTCCCAGCAGACGTCTTCATGGTGCCAC
AGTATGGATACCTCACCCTGAACAACGGGAGTCAGGCAGTAGGACGCTCTTCATTTTACTGCCTGGAGTA
CTTTCCTTCTCAGATGCTGCGTACCGGAAACAACTTTACCTTCAGCTACACTTTTGAGGACGTTCCTTTC
CACAGCAGCTACGCTCACAGCCAGAGTCTGGACCGTCTCATGAATCCTCTCATCGACCAGTACCTGTATT
ACTTGAGCAGAACAAACACTCCAAGTGGAACCACCACGCAGTCAAGGCTTCAGTTTTCTCAGGCGGAGC
GAGTGACATTCGGGACCAGTCTAGGAACTGGCTTCCTGGACCCTGTTACCGCCAGCAGCGAGTATCAAAG
ACATCTGCGGATAACAACAACAGTGAATACTCGTGGACTGGAGCTACCAAGTACCACCTCAATGGCAGAG
ACTCTCTGGTGAATCCGGGCCCGGCCATGGCAAGCCACAAGGACGATGAAGAAAAGTTTTTTCCTCAGAG
CGGGGTTCTCATCTTTGGGAAGCAAGGCTCAGAGAAAACAAATGTGGACATTGAAAAGGTCATGATTACA
GACGAAGAGGAAATCAGGACAACCAATCCCGTGGCTACGGAGCAGTATGGTTCTGTATCTACCAACCTCC
AGAGAGGCAACAGACAAGCAGCTACCGCAGATGTCAACACACAAGGCGTTCTTCCAGGCATGGTCTGGCA
GGACAGAGATGTGTACCTGCAAGGACCCATTTGGGCCAAAATTCCTCACACGGACGGCAACTTTCACCCT
TCTCCGCTGATGGGCGGCTTTGGACTCAAGAACCCGCCTCCTCAGATCCTCATCAAAAACACGCCTGTTC
CTGCGAATCCTCCGGCGGAGTTTTCAGCTACAAAGTTTGCTTCATTCATCACCCAATACTCCACAGGACA
AGTGAGTGTGGAAATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCTATTGGCACTCGTTACCTCACCCGTAATCTGTAA

FIG. 3OO

H40 AMINO ACID SEQUENCE (SEQ ID NO:28)
MAADGYLPDWLEDTLSEGIRQWWKLKPGPPPPKPAERHKDDSRGLVLPGYKYLGPFNGLDKGEPVNEADA
AALEHDKAYDRQLDSGDNPYLKYNHADAEFQERLKEDTSFGGNLGRAVFQAKKRVLEPLGLVEEPVKTAP
GKKRPVEHSPVEPDSSSGTGKAGQQPARKRLNFGQTGDADSVPDPQPLGQPPAAPSGLGTNTMATGSGAP
MADNNEGADGVGNSSGNWHCDSTWMGDRVITTSTRTWALPTYNNHLYKQISSQSGASNDNHYFGYSTPWG
YFDFNRFHCHFSPRDWQRLINNNWGFRPKRLNFKLFNIQVKEVTQNDGTTTIANNLTSTVQVFTDSEYQL
PYVLGSAHQGCLPPFPADVFMVPQYGYLTLNNGSQAVGRSSFYCLEYFPSQMLRTGNNFTFSYTFEDVPF
HSSYAHSQSLDRLMNPLIDQYLYYLSRTNTPSGTTTQSRLQFSQAGASDIRDQSRNWLPGPCYRQQRVSK
TSADNNNSEYSWTGATKYHLNGRDSLVNPGPAMASHKDDEEKFFPQSGVLIFGKQGSEKTNVDIEKVMIT
DEEEIRTTNPVATEQYGSVSTNLQRGNRQAATADVNTQGVLPGMVWQDRDVYLQGPIWAKIPHTDGNFHP
SPLMGGFGLKNPPPQILIKNTPVPANPPAEFSATKFASFITQYSTGQVSVEIEWELQKENSKRWNPEVQY
TSNYAKSANVDFTVDNNGLYTEPRPIGTRYLTRNL

FIG. 3PP

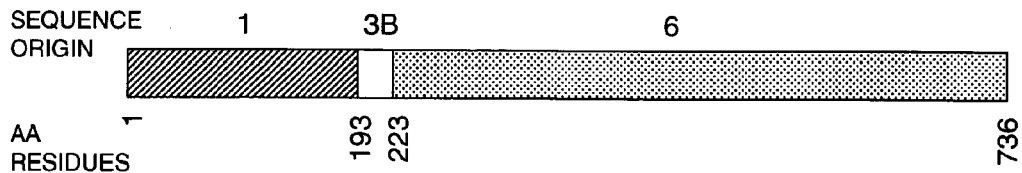

PHYLOGENETIC ORIGIN OF H43 AAV CAPSID GENE

FIG. 3QQ

H43 CODING SEQUENCE (SEQ ID NO:29)
ATGGCTGCCGATGGTTATCTTCCAGATTGGCTCGAGGACAACCTCTCTGAGGGCATTCGCGAGTGGTGGG
ACTTGAAACCTGGAGCCCCGAAGCCCAAAGCCAACCAGCAAAAGCAGGACGACGGCCGGGGTCTGGTGCT
TCCTGGCTACAAGTACCTCGGACCCTTCAACGGACTCGACAAGGGGGAGCCCGTCAACGCGGCGGACGCA
GCGGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGCGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCTAAAAAGAGACTCAATTTTGGTCAGACTGGCGACTCAGAGTCAGTTCCAGACCCTCAACC
TCTCGGAGAACCACCAGCAGCCCCCACAAGTTTGGGATCTAATACAATGGCTTCAGGCGGTGGCGCACCA
ATGGCAGACAATAACGAAGGCGCCGACGAGTGGGTAATGCCTCAGGAAATTGGCATTGCGATTCCACAT
GGCTGGCGACAGAGTCATCACCACCAGCACCCGAACATGGGCCTTGCCCACCTATAACAACCACCTCTA
CAAGCAAATCTCCAGTGCTTCAACGGGGCCAGCAACGACAACCACTACTTCGGCTACAGCACCCCCTGG
GGGTATTTTGATTTCAACAGATTCCACTGCCATTTCTCACCACGTGACTGGCAGCGACTCATCAACAACA
ATTGGGGATTCCGGCCCAAGAGACTCAACTTCAAGCTCTTCAACATCCAAGTCAAGGAGGTCACGACGAA
TGATGGCGTCACGACCATCGCTAATAACCTTACCAGCACGGTTCAAGTCTTCTCGGACTCGGAGTACCAG
TTGCCGTACGTCCTCGGCTCTGCGCACCAGGGCTGCCTCCCTCCGTTCCCGGCGGACGTGTTCATGATTC
CGCAATACGGCTACCTGACGCTCAACAATGGCAGCCAAGCCGTGGGACGTTCATCCTTTTACTGCCTGGA
ATATTTCCCTTCTCAGATGCTGAGAACGGGCAACAACTTTACCTTCAGCTACACCTTTGAGGAAGTGCCT
TTCCACAGCAGCTACGCGCACAGCCAGAGCCTGGACCGGCTGATGAATCCTCTCATCGACCAGTACCTGT
ATTACCTGAACAGAACTCAGAATCAGTCCGGAAGTGCCCAAAACAAGGACTTGCTGTTTAGCCGTGGGTC
TCCAGCTGGCATGTCTGTTCAGCCCAAAAACTGGCTACCTGGACCCTGTTACCGGCAGCAGCGCGTTTCT
AAAACAAAAACAGACAACAACAACAGCAACTTTACCTGGACTGGTGCTTCAAAATATAACCTCAATGGGC
GTGAATCCATCATCAACCCTGGCACTGCTATGGCCTCACACAAAGACGACAAAGACAAGTTCTTTCCCAT
GAGCGGTGTCATGATTTTTGGAAAGGAGAGCGCCGGAGCTTCAAACACTGCATTGGACAATGTCATGATC
ACAGACGAAGAGGAAATCAAAGCCACTAACCCCGTGGCCACCGAAAGATTTGGGACTGTGGCAGTCAATC
TCCAGAGCAGCAGCACAGACCCTGCGACCGGAGATGTGCATGTTATGGGAGCCTTACCTGGAATGGTGTG
GCAAGACAGAGACGTATACCTGCAGGGTCCTATTTGGGCCAAAATTCCTCACACGGATGGACACTTTCAC
CCGTCTCCTCTCATGGGCGGCTTTGGACTTAAGCACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAACGCTGGAATCCCGAAGTGCAG
TATACATCTAACTATGCAAAATCTGCCAACGTTGATTTTACTGTGGACAACAATGGACTTTATACTGAGC
CTCGCCCCATTGGCACCCGTTACCTTACCCGTCCCCTGTAA

FIG. 3RR

H43 AMINO ACID SEQUENCE (SEQ ID NO:30)
MAADGYLPDWLEDNLSEGIREWWDLKPGAPKPKANQQKQDDGRGLVLPGYKYLGPFNGLDKGEPVNAADA
AALEHDKAYDQQLKAGDNPYLRYNHADAEFQERLQEDTSFGGNLGRAVFQAKKRVLEPLGLVEEGAKTAP
GKKRPVEQSPQEPDSSSGIGKTGQQPAKKRLNFGQTGDSESVPDPQPLGEPPAAPTSLGSNTMASGGGAP
MADNNEGADGVGNASGNWHCDSTWLGDRVITTSTRTWALPTYNNHLYKQISSASTGASNDNHYFGYSTPW
GYFDFNRFHCHFSPRDWQRLINNNWGFRPKRLNFKLFNIQVKEVTTNDGVTTIANNLTSTVQVFSDSEYQ
LPYVLGSAHQGCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNLQSSSTDPATGDVHVMGALPGMVWQDRDVYLQGPIWAKIPHTDGHFH
PSPLMGGFGLKHPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3SS

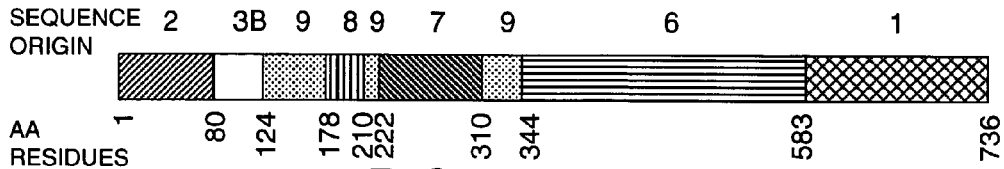

FIG. 3TT

PHYLOGENETIC ORIGIN OF H50 AAV CAPSID GENE

H50 CODING SEQUENCE (SEQ ID NO:31)
ATGGCTGCCGATGGTTATCTTCCAGATTGGCTCGAGGACACTCTCTCTGAAGGAATAAGACAGTGGTGGA
AGCTCAAACCTGGCCCACCACCACCAAAGCCCGCAGAGCGGCATAAGGACGACAGCAGGGGTCTTGTGCT
TCCTGGGTACAAGTACCTCGGACCCTTCAACGGACTCGACAAGGGAGAGCCGGTCAACGAGGCAGACGCC
GCGGCCCTCGAGCACGACAAAGCCTACGACCAGCAGCTCAAGGCCGGTGACAACCCGTACCTCAAGTACA
ACCACGCCGACGCCGAGTTTCAGGAGCGTCTTCAAGAAGATACGTCTTTTGGGGGCAACCTCGGGCGAGC
AGTCTTCCAGGCCAAAAAGAGGCTTCTTGAACCTCTTGGTCTGGTTGAGGAAGCGGCTAAGACGGCTCCT
GGAAAGAAGAGGCCTGTAGAGCAGTCTCCTCAGGAACCGGACTCCTCCGCGGGTATTGGCAAATCGGGTG
CACAGCCGCTAAAAAGAGACTCAATTTCGGTCAGCATGGCGACTCAGAGTCAGTTCCAGACCCTCAACC
TCTCGGAGAACCTCCAGCAGCGCCCTCTGGTGTGGGACCTAATACAATGGCTGCAGGCGGTGGCGCACCA
GTGGCAGACAATAACGAAGGCGCCGACGAGTGGGTAATGCCTCAGGAAATTGGCATTGCGATTCCACAT
GGCTGGGCGACAGAGTCATTACCACCAGCACCCGAACCTGGGCCCTGCCCACCTACAACAACCACCTCTA
CAAGCAAATCTCCAGTGAAACTGCAGGTAGTACCAACGACAACACCTACTTCGGCTACAGCACCCCTGG
GGGTATTTTGATTTCAACAGATTCCACTGCCATTTCTCACCACGTGACTGGCAGCGACTCATTAACAACA
ACTGGGGATTCCGGCCTAAGCGACTCAACTTCAAGCTCTTCAACATTCAGGTCAAAGAGGTTACGGACAA
CAATGGAGTCAAGACCATCGCCAATAACCTTACCAGCACGGTTCAAGTCTTCTCGGACTCGGAGTACCAG
CTTCCGTACGTCCTCGGCTCTGCGCACCAGGGCTGCCTCCCTCCGTTCCCGGCGGACGTGTTCATGATTC
CGCAATACGGCTACCTGACTCTCAACAATGGCAGCCAAGCCGTGGGACGCTCCTCCTTCTACTGCCTGGA
ATACTTTCCTTCGCAGATGCTGAGAACGGGCAACAACTTTACCTTCAGCTACACCTTTGAGGACGTGCCT
TTCCACAGCAGCTACGCGCACAGCCAGAGCCTGGACCGGCTGATGAATCCTCTCATCGACCAGTACCTGT
ATTACCTGAACAGAACTCAGAATCAGTCCGGAAGTGCCCAAAACAAGGACTTGCTGTTTAGCCGGGGGTC
TCCAGCTGGCATGTCTGTTCAGCCCAAAAACTGGCTACCTGGACCCTGTTACCGGCAGCAGCGCGTTTCT
AAAACAAAAACAGACAACAACAACAGCAACTTTACCTGGACTGGTGCTTCAAAATATAACCTCAATGGGC
GTGAATCTATAATCAACCCTGGCACTGCTATGGCCTCACACAAAGACGACAAAGACAAGTTCTTTCCCAT
GAGCGGTGTCATGATTTTTGGAAAAGAGAGCGCCGGAGCTTCAAACACTGCATTGGACAATGTCATGATT
ACAGACGAAGAGGAAATTAAAGCCACTAACCCTGTGGCCACCGAAAGATTTGGGACCGTGGCAGTCAATT
TCCAGAGCAGCACAGACCCTGCGACCGGAGATGTGCATGCTATGGGAGCATTACCTGGCATGGTGTG
GCAAGATAGAGACGTGTACCTGCAGGGTCCCATTTGGGCCAAAATTCCTCACACAGATGGACACTTTCAC
CCGTCTCCTCTTATGGGCGGCTTTGGACTCAAGAACCCGCCTCCTCAGATCCTCATCAAAAACACGCCTG
TTCCTGCGAATCCTCCGGCGGAGTTTTCAGCTACAAAGTTTGCTTCATTCATCGACCCAGTATTCCACAGG
ACAAGTGAGCGTGGAGATTGAATGGGAGCTGCAGAAAGAAAACAGCAAACGCTGGAATCCCGAAGTGCAG
TATACATCTAACTATGCAAAATCTGCCAACGTTGATTTCACTGTGGACAACAATGGACTTTATACTGAGC
CTCGCCCCATTGGCACCCGTTACCTCACCCGTCCCCTGTAA

FIG. 3UU

H50 AMINO ACID SEQUENCE (SEQ ID NO:32)
MAADGYLPDWLEDTLSEGIRQWWKLKPGPPPPKPAERHKDDSRGLVLPGYKYLGPFNGLDKGEPVNEADA
AALEHDKAYDQQLKAGDNPYLKYNHADAEFQERLQEDTSFGGNLGRAVFQAKKRLLEPLGLVEEAAKTAP
GKKRPVEQSPQEPDSSAGIGKSGAQPAKKRLNFGQTGDSESVPDPQPLGEPPAAPSGVGPNTMAAGGGAP
VADNNEGADGVGNASGNWHCDSTWLGDRVITTSTRTWALPTYNNHLYKQISSETAGSTNDNTYFGYSTPW
GYFDFNRFHCHFSPRDWQRLINNNWGFRPKRLNFKLFNIQVKEVTDNNGVKTIANNLTSTVQVFSDSEYQ
LPYVLGSAHQGCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNFQSSTDPATGDVHAMGALPGMVWQDRDVYLQGPIWAKIPHTDGHFH
PSPLMGGFGLKNPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3VV

PHYLOGENETIC ORIGIN OF H53 AAV CAPSID GENE

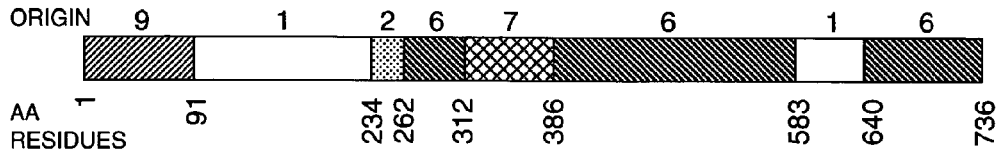

FIG. 3WW

H53 CODING SEQUENCE (SEQ ID NO:33)
ATGGCTGCCGATGGTTATCTTCCAGATTGGCTCGAGGACAACCTCTCTGAGGGCATTCGCGAGTGGTGGG
ACTTGAAACCTGGAGCCCCTCAACCCAAGGCAAATCAACAACATCAAGACAACGCTCGAGGTCTGGTGCT
TCCGGGTTACAAATACCTTGGACCCGGCAACGGACTCGACAAGGGGGAGCCGGTCAACGCAGCAGACGCG
GCGGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGCGGGTTCTCGAACCTCTCGGTCTGGTTGAGGAAGGTGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCTAAAAAGAGACTCAATTTTGGTCAGACTGGCGACTCAGAGTCAGTCCCCGATCCACAACC
TCTCGGAGAACCTCCAGCAACCCCCGCTGCTGTGGGACCTACTACAATGGCTTCAGGCGGTGGCGCACCA
ATGGCAGACAATAACGAAGGCGCCGACGGAGTGGGTAATGCCTCAGGAAATTGGCATTGCGATTCCACAT
GGATGGGCGACAGAGTCATCACCACCAGCACCCGCACCTGGGCCTTGCCCACCTACAATAACCACCTCTA
CAAGCAAATCTCCAGTGCTTCAACGGGGCCAGCAACGACAACCACTACTTCGGCTACAGCACCCCCTGG
GGGTATTTTGATTTCAACAGATTCCACTGCCATTTCTCACCACGTGACTGGCAGCGACTCATCAACAACA
ACTGGGGATTCCGGCCCAAGAAGCTGCGGTTCAAGCTCTTCAACATCCAAGTCAAGGAGGTCACGACGAA
TGATGGCGTCACGACCATCGCTAATAACCTTACCAGCACGGTTCAAGTCTTCTCGGACTCGGAGTACCAG
CTTCCGTACGTCCTCGGCTCTGCGCACCAGGGCTGCCTCCCTCCGTTCCCGGCGGACGTGTTCATGATTC
CGCAATACGGCTACCTGACGCTCAACAATGGCAGCCAAGCCGTGGGACGTTCATCCTTTTACTGCCTGGA
ATATTTCCCATCGCAGATGCTGAGAACGGGCAACAACTTTACCTTCAGCTACACCTTTGAGGAAGTGCCT
TTCCACAGCAGCTACGCGCACAGCCAGAGCCTGGACCGGCTGATGAATCCTCTCATCGACCAATACCTGT
ATTACCTGAACAGAACTCAAAATCAGTCCGGAAGTGCCCAAAACAAGGACTTGCTGTTTAGCCGGGGGTC
TCCAGCTGGCATGTCTGTTCAGCCCAAAAACTGGCTACCTGGACCCTGTTACCGGCAGCAGCGCGTTTCT
AAAACAAAAACAGACAACAACAACAGCAACTTTACCTGGACTGGTGCTTCAAAATATAACCTTAATGGGC
GTGAATCTATAATCAACCCTGGCACTGCTATGGCCTCACACAAAGACGACAAAGACAAGTTCTTTCCCAT
GAGCGGTGTCATGATTTTTGGAAAAGAGAGCGCCGGAGCTTCAAACACTGCATTGGACAATGTCATGATT
ACAGACGAAGAGGAAATTAAAGCCACTAACCCTGTGGCCACCGAAAGATTTGGGACCGTGGCAGTCAATT
TCCAGAGCAGCAGCACAGACCCTGCGACCGGAGATGTGCATGCTATGGGAGCATTACCTGGCATGGTGTG
GCAAGATAGAGACGTGTACCTGCAGGGTCCTATTTGGGCCAAAATTCCTCACACGGATGGACACTTTCAC
CCGTCTCCTCTCATGGGCGGCTTTGGACTTAAGCACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAGAAAACAGCAAACGCTGGAATCCCGAAGTGCAG
TATACATCTAACTATGCAAATCTGCCAACGTTGATTTCACTGTGGACAACAATGGACTTTATACTGAGC
CTCGCCCCATTGGCACCCGTTACCTCACCCGTCCCCTGTAA

FIG. 3XX

H53 AMINO ACID SEQUENCE (SEQ ID NO:34)
MAADGYLPDWLEDNLSEGIREWWDLKPGAPQPKANQQHQDNARGLVLPGYKYLGPGNGLDKGEPVNAADA
AALEHDKAYDQQLKAGDNPYLRYNHADAEFQERLQEDTSFGGNLGRAVFQAKKRVLEPLGLVEEGAKTAP
GKKRPVEQSPQEPDSSSGIGKTGQQPAKKRLNFGQTGDSESVPDPQPLGEPPATPAAVGPTTMASGGGAP
MADNNEGADGVGNASGNWHCDSTWMGDRVITTSTRTWALPTYNNHLYKQISSASTGASNDNHYFGYSTPW
GYFDFNRFHCHFSPRDWQRLINNNWGFRPKKLRFKLFNIQVKEVTTNDGVTTIANNLTSTVQVFSDSEYQ
LPYVLGSAHQGCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNFQSSSTDPATGDVHAMGALPGMVWQDRDVYLQGPIWAKIPHTDGHFH
PSPLMGGFGLKHPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3YY

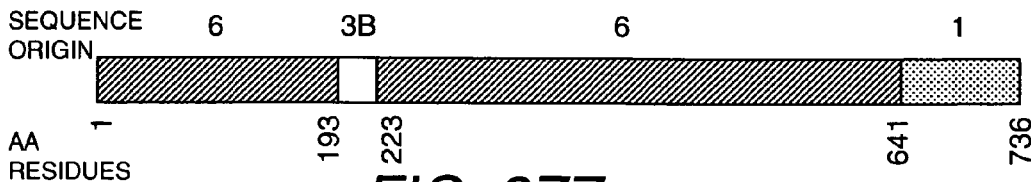

PHYLOGENETIC ORIGIN OF H66 AAV CAPSID GENE

FIG. 3ZZ

H66 CODING SEQUENCE (SEQ ID NO:35)
ATGGCTGCCGATGGTTATCTTCCAGATTGGCTCGAGGACAACCTCTCTGAGGGCATTCGCGAGTGGTGGG
ACTTGAAACCTGGAGCCCCGAAACCCAAAGCCAACCAGCAAAAGCAGGACGACGGCCGGGGTCTGGTGCT
TCCTGGCTACAAGTACCTCGGACCCTTCAACGGACTCGACAAGGGGGAACCCGTCAACGCGGCGGACGCG
GCGGCCCTCGAGCACGACAAGGCCTACGACCAGCAGCTCAAAGCGGGTGACAATCCGTACCTGCGGTATA
ACCACGCCGACGCCGAGTTTCAGGAGCGTCTGCAAGAAGATACGTCTTTTGGGGGCAACCTCGGGCGAGC
AGTCTTCCAGGCCAAGAAGAGGGTTCTCGAACCTTTTGGTCTGGTTGAGGAAGGTGCTAAGACGGCTCCT
GGAAAGAAACGTCCGGTAGAGCAGTCGCCACAAGAGCCAGACTCCTCCTCGGGCATCGGCAAGACAGGCC
AGCAGCCCGCTAAAAAGAGACTCAATTTTGGTCAGACTGGCGACTCAGAGTCAGTCCCAGACCCTCAACC
TCTCGGAGAACCACCAGCAGCCCCCACAAGTTTGGGATCTAATACAATGGCTTCAGGCGGTGGCGCACCA
ATGGCAGACAATAACGAAGGCGCCGACGGAGTGGGTAATGCCTCAGGAAATTGGCATTGCGATTCCACAT
GGCTGGGCGACAGAGTCATCACCACCAGCACCCGAACATGGGCCTTGCCCACCTACAACAATCACCTCTA
CAAGCAAATCTCCAGTGCTTCAACGGGGCCAGCAACGACAACCACTACTTCGGCTACAGCACCCCCTGG
GGGTATTTTGATTTCAACAGATTCCACTGCCACTTTTCACCACGTGACTGGCAGCGACTCATCAACAACA
ATTGGGGATTCCGGCCCAAGAGACTCAACTTCAAACTCTTCAACATCCAAGTCAAGGAGGTCACGACGAA
TGATGGCGTCACGACCATCGCTAATAACCTTACCAGCACGGTTCAAGTCTTCTCGGACTCGGAGTACCAG
TTGCCGTACGTCCTCGGCTCTGCGCACCAGGGCTGCCTCCCTCCGTTCCCGGCGGACGTGTTCATGATTC
CGCAGTACGGCTACCTAACGCTCAACAATGGCAGCCAGGCAGTGGGACGGTCATCCTTTTACTGCCTGGA
ATATTTCCCATCGCAGATGCTGAGAACGGGCAACAACTTTACCTTCAGCTACACCTTTGAGGAAGTGCCT
TTCCACAGCAGCTACGCGCACAGCCAGAGCCTGGACCGGCTGATGAATCCTCTCATCGACCAATACCTGT
ATTACCTGAACAGAACTCAAAATCAGTCCGGAAGTGCCCAAAACAAGGACTTGCTGTTTAGCCGTGGGTC
TCCAGCTGGCATGTCTGTTCAGCCCAAAAACTGGCTACCTGGACCCCTGTTACCGGCCAGCAGCGCGTTTCT
AAAACAAAAACAGACAACAACAACAGCAACTTTACCTGGACTGGTGCTTCAAAATATAACCTTAATGGGC
GTGAATCTATAATCAACCCTGGCACTGCTATGGCCTCACACAAAGACGACAAAGACAAGTTCTTTCCCAT
GAGCGGTGTCATGATTTTTGGAAAGGAGAGCGCCGGAGCTTCAAACACTGCATTGGACAATGTCATGATC
ACAGACGAAGAGGAAATCAAAGCCACTAACCCCGTGGCCACCGAAAGATTTGGGACTGTGGCAGTCAATC
TCCAGAGCAGCAGCACAGACCCTGCGACCGGAGATGTGCATGTTATGGGAGCCTTACCTGGAATGGTGTG
GCAAGACAGAGACGTATACCTGCAGGGTCCTATTTGGGCCAAAATTCCTCACACGGATGGACACTTTCAC
CCGTCTCCTCTTATGGGCGGCTTTGGACTCAAGAACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAACGCTGGAATCCCGAAGTGCAG
TATACATCTAACTATGCAAAATCTGCCAACGTTGATTTCACTGTGGACAACAATGGACTTTATACTGAGC
CTCGCCCCATTGGCACCCGTTACCTCACCCGTCCCCTGTAA

FIG. 3AAA

H66 AMINO ACID SEQUENCE (SEQ ID NO:36)
MAADGYLPDWLEDNLSEGIREWWDLKPGAPKPKANQQKQDDGRGLVLPGYKYLGPFNGLDKGEPVNAADA
AALEHDKAYDQQLKAGDNPYLRYNHADAEFQERLQEDTSFGGNLGRAVFQAKKRVLEPFGLVEEGAKTAP
GKKRPVEQSPQEPDSSSGIGKTGQQPAKKRLNFGQTGDSESVPDPQPLGEPPAAPTSLGSNTMASGGGAP
MADNNEGADGVGNASGNWHCDSTWLGDRVITTSTRTWALPTYNNHLYKQISSASTGASNDNHYFGYSTPW
GYFDFNRFHCHFSPRDWQRLINNNWGFRPKRLNFKLFNIQVKEVTTNDGVTTIANNLTSTVQVFSDSEYQ
LPYVLGSAHQGCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNLQSSSTDPATGDVHVMGALPGMVWQDRDVYLQGPIWAKIPHTDGHFH
PSPLMGGFGLKNPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3BBB

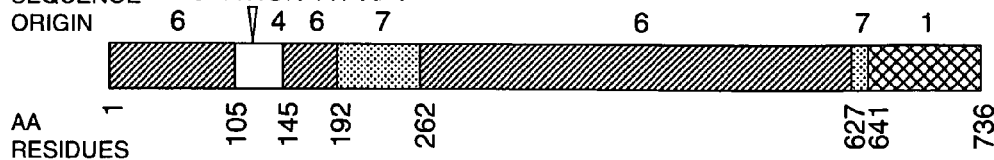

FIG. 3CCC

H109 CODING SEQUENCE (SEQ ID NO:37)
ATGGCTGCCGATGGTTATCTTCCAGATTGGCTCGAGGACAACCTCTCTGAGGGCATTCGCGAGTGGTGGG
ACTTGAAACCTGGAGCCCCGAAACCCAAAGCCAACCAGCAAAAGCAGGACGACGGCCGGGGTCTGGTGCT
TCCTGGCTACAAGTACCTCGGACCCTTCAACGGACTCGACAAGGGGGAGCCCGTCAACGCGGCGGATGCA
GCGGCCCTCGAGCACGACAAGGCCTACGACCAGCAGCTCAAGGCCGGTGACAACCCCTACCTCAAGTACA
ACCACGCCGACGCGGAGTTCCAGCAGCGGCTTCAGGGCGACACATCGTTTGGGGGCAACCTCGGCAGAGT
AGTCTTCCAGGCCAAGAAGAGGGTTCTTGAACCTCTTGGTCTGGTTGAGCAAGCGGGTGAGACGGCTCCT
GGAAAGAAACGTCCGGTAGAGCAGTCGCCACAAGAGCCAGACTCCTCCTCGGGCATTGGCAAGACAGGCC
AGCAGCCCGCTAAAAAGAGACTCAATTTTGGTCAGACTGGCGACTCAGAGTCAGTCCCCGACCCTCAACC
TCTCGGAGAACCTCCAGCAGCGCCCTCTAGTGTGGGATCTGGTACAGTGGCTGCAGGCGGTGGCGCACCA
ATGGCAGACAATAACGAAGGTGCCGACGGAGTGGGTAATGCCTCAGGAAATTGGCATTGCGATTCCACAT
GGCTGGGCGACAGAGTCATCACCACCAGCACCCGCACCTGGGCCTTGCCCACCTACAATAACCACCTCTA
CAAGCAAATCTCCAGTGCTTCAACGGGGGCCAGCAACGACAACCACTACTTCGGCTACAGCACCCCCTGG
GGGTATTTTGATTTCAACAGATTCCACTGCCATTTCTCACCACGTGACTGGCAGCGACTCATCAACAACA
ATTGGGGATTCCGGCCCAAGAGACTCAACTTCAAGCTCTTCAACATCCAAGTCAAGGAGGTCACGACGAA
TGATGGCGTCACGACCATCGCTAATAACCTTACCAGCACGGTTCAAGTCTTCTCGGACTCGGAGTACCAG
TTGCCGTACGTCCTCGGCTCTGCGCACCAGGGCTGCCTCCCTCCGTTCCCGGCGGACGTGTTCATGATTC
CGCAGTACGGCTACCTAACGCTCAACAATGGCAGCCAGGCAGTGGGACGGTCATCCTTTTACTGCCTGGA
ATATTTCCCATCGCAGATGCTGAGAACGGGCAATAACTTTACCTTCAGCTACACCTTCGAGGACGTGCCT
TTCCACAGCAGCTACGCGCACAGCCAGAGCCTGGACCGGCTGATGAATCCTCTCATCGACCAGTACCTGT
ATTACCTGAACAGAACTCAGAATCAGTCCGGAAGTGCCCAAAACAAGGACTTGCTGTTTAGCCGTGGGTC
TCCAGTTGGCATGTCTGTTCAGCCCAAAAACTGGCTACCTGGACCCTGTTATCGGCAGCAGCGCGTTTCT
AAAACAAAAACAGACAACAACAACAGCAATTTTACCTGGACTGGTGCTTCAAAATATAACCTCAATGGGC
GTGAATCCATCATCAACCCTGGCACTGCTATGGCCTCACACAAAGACGACAAAGACAAGTTCTTTCCCAT
GAGCGGTGTCATGATTTTTGGAAAGGAGAGCGCCGGAGCTTCAAACACTGCATTGGACAATGTCATGATT
ACAGACGAAGAGGAAATCAAAGCCACTAACCCCGTGGCCACCGAAAGATTTGGGACTGTGGCAGTCAATC
TCCAGAGCAGCAGCACAGACCCTGCGACCGGAGATGTGCATGTTATGGGAGCCTTACCTGGTATGGTTTG
GCAGGACAGAGATGTGTACCTGCAAGGACCCATTTGGGCCAAAATTCCTCACACGGACGGCAACTTTCAC
CCTTCTCCTCTTATGGGCGGCTTTGGACTCAAGAACCCGCCTCCTCAGATCCTCATCAAAAACACGCCTG
TTCCTGCGAATCCTCCGGCGGAGTTTTCAGCTACAAAGTTTGCTTCATTCATCACCCAATACTCCACAGG
ACAAGTGAGTGTGGAAATTGAATGGGAGCTGCAGAAAGAAAACAGCAAGCGCTGGAATCCCGAAGTGCAG
TACACATCCAATTATGCAAAATCTGCCAACGTTGATTTTACTGTGGACAACAATGGACTTTATACTGAGC
CTCGCCCCATTGGCACCCGTTACCTTACCCGTCCCCTGTAA

FIG. 3DDD

H109 AMINO ACID SEQUENCE (SEQ ID NO:38)
MAADGYLPDWLEDNLSEGIREWWDLKPGAPKPKANQQKQDDGRGLVLPGYKYLGPFNGLDKGEPVNAADA
AALEHDKAYDQQLKAGDNPYLKYNHADAEFQQRLQGDTSFGGNLGRVVFQAKKRVLEPLGLVEQAGETAP
GKKRPVEQSPQEPDSSSGIGKTGQQPAKKRLNFGQTGDSESVPDPQPLGEPPAAPSSVGSGTVAAGGGAP
MADNNEGADGVGNASGNWHCDSTWLGDRVITTSTRTWALPTYNNHLYKQISSASTGASNDNHYFGYSTPW
GYFDFNRFHCHFSPRDWQRLINNNWGFRPKRLNFKLFNIQVKEVTTNDGVTTIANNLTSTVQVFSDSEYQ
LPYVLGSAHQGCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPVGMSVQPKNWLPGPCYRQQRVS
KTKTDNNNSNFTWTGASKYNLNGRESIINPGTAMASHKDDKDKFFPMSGVMIFGKESAGASNTALDNVMI
TDEEEIKATNPVATERFGTVAVNLQSSSTDPATGDVHVMGALPGMVWQDRDVYLQGPIWAKIPHTDGNFH
PSPLMGGFGLKNPPPQILIKNTPVPANPPAEFSATKFASFITQYSTGQVSVEIEWELQKENSKRWNPEVQ
YTSNYAKSANVDFTVDNNGLYTEPRPIGTRYLTRPL

FIG. 3EEE

HH1 CODING SEQUENCE (SEQ ID NO:39)

GCTGCCGATGGTTATCTTCCAGATTGGCTCGAGGACAACCTCTCTGAGGGCATTCGCGAGTGGTGGGACT
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAACCCGTCAACGCGGCGGACGCGGCG
GCCCTCGAGCACGACAAGGCCTACGACCAGCAGCTCAAGGCCGGTGACAACCCGTACCTCAAGTACAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTCGGTCAGACTGGCGACTCAGAGTCAGTCCCAGACCCTCAACCTCT
CGGAGAACCTCCAGCAGCGCCCTCTAGTGTGGGATCTGGTACAGTGGCTTCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATTACCACCAGCACCCGCACCTGGGCCTTGCCCACCTACAATAACCACCTCTACAA
GCAAATCTCCAGTGCTTCAACGGGGCCAGCAACGACAACCACTACTTCGGCTACAGCACCCCTGGGGG
TATTTTGATTTCAACAGATTCCACTGCCACTTTTCACCACGTGACTGGCAGCGACTCATCAACAACAATT
GGGGATTCCGGCCCAAGAGACTCAACTTCAAACTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAAGCCGTGGGACGGTCATCCTTTTACTGCCTGGAATA
TTTCCCTTCTCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATCAAAGCCACTAACCCCGTGGCCACCGAAAGATTTGGGACTGTGGCAGTCAATTTCC
AGAGCAGCAGCACAGACCCTGCGACCGGAGATGTGCATGTTATGGGAGCCTTACCTGGAATGGTGTGGCA
AGACAGAGACGTATACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGTGTGGAGATTGAATGGGAACTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTTACCCGTCCCCTGTAA

*FIG. 6A*

HH1 AMINO ACID SEQUENCE (SEQ ID NO:40)
DGYLPDWLEDNLSEGIREWWDLKPGAPKPKANQQKQDDGRGLVLPGYKYLGPFNGLDKGEPVNAADAAAL
EHDKAYDQQLKAGDNPYLKYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSSVGSGTVASGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHVMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6B*

HH15 CODING SEQUENCE (SEQ ID NO:41)
GCTGCCGATGGTTATCTTCCAGATTGGCTCGAGGACAACCTCTCTGAGGGCATTCGCGAGTGGTGGGACC
TGAAACCTGGAGCCCCGAAACCCAAAGCCAACCAGCAAAAGCAGGACAACGGCCGGGGTCTGGTGCTTCC
TGGCTACAAGTACCTCGGACCCTTCAACGGACTCGACAAGGGGGAGCCGGTCAACGCAGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTTTTGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCAGACCCTCAACCTCT
CGGAGAACCTCCAGCAACCCCCGCTGCTGTGGGACCTACTACAATGGCTACAGGCAGTGGCGCACCAATG
GCAGACAATAACGAGGGTGCCGACGGAGTGGGTAATGCCTCAGGAAATTGGCATTGCGATTCCACATGGC
TGGGCGACAGAGTCATCACCACCAGCACCCGAACATGGGCCCTGCCCACCTACAACAACCACCTCTACAA
GCAAATCTCCAACAGCACATCTGGAGGATCTTCAAATGACAACGCCTACTTCGGCTACAGCACCCCCTGG
GGGTATTTTGATTTCAACAGATTCCACTGCCACTTTTCACCACGTGACTGGCAGCGACTCATCAACAACA
ATTGGGGATTCCGGCCCAAGAGACTCAACTTCAAACTCTTCAACATCCAAGTCAAGGAGGTCACGACGAA
TGACGGCGTTACGACCATCGCTAATAACCTTACCAGCACGGTTCAAGTCTTCTCGGACTCGGAGTACCAG
TTGCCGTACGTCCTCGGCTCTGCGCACCAGGGCTGCCTCCCTCCGTTCCCGGCGGACGTGTTCATGATTC
CGCAATACGGCTACCTGACGCTCAACAATGGCAGCCAGGCAGTGGGACGGTCATCCTTTTACTGCCTGGA
ATATTTCCCATCGCAGATGCTGAGAACGGGCAACAACTTTACCTTCAGCTACACCTTCGAGGACGTGCCT
TTCCACAGCAGCTACGCGCACAGCCAGAGCCTGGACCGGCTGATGAATCCTCTCATCGACCAGTACCTGT
ATTACCTGAACAGAACTCAAAATCAGTCCGGAAGTGCCCAAAACAAGGACTTGCTGTTTAGCCGTGGGTC
TCCAGCTGGCATGTCTGTTCAGCCCAAAAACTGGCTACCTGGACCCTGTTATCGGCAGCAGCGCGTTTCT
AAAACAAAAACAGACAACAACAACAGCAACTTTACCTGGACTGGTGCTTCAAAATATAACCTCAATGGGC
GTGAATCCATCATCAACCCTGGCACTGCTATGGCCTCACACAAAGACGACAAAGACAAGTTCTTTCCCAT
GAGCGGTGTCATGATTTTTGGAAAAGAGAGCGCCGGAGCTTCAAACACTGCATTGGACAATGTCATGATT
ACAGACGAAGAGGAAATCAAAGCCACTAACCCCGTGGCCACCGAAAGATTTGGGACCGTGGCAGTCAATC
TCCAGAGCAGCAGCACAGACCCTGCGACCGGAGATGTGCATGTTATGGGAGCCTTACCTGGAATGGTGTG
GCAAGATAGAGACGTGTACCTGCAGGGTCCCATTTGGGCCAAAATTCCTCACACAGATGGACACTTTCAC
CCGTCTCCTCTTATGGGCGGCTTTGGACTCAAGAACCCGCCTCCTCAGATCCTCATCAAAAACACGCCTG
TTCCTGCGAATCCTCCGGCAGAGTTTTCGGCTACAAAGTTTGCTTCATTCATCACCCAGTATTCCACAGG
ACAAGTGAGCGTGGAGATTGAATGGGAGCTGCAGAAAGAAAACAGCAAGCGCTGGAATCCCGAAGTGCAG
TACACATCCAATTATGCAAAATCTGCCAACGTTGATTTTACTGTGGACAACAATGGACTTTATACTGAGC
CTCGCCCCATTGGCACCCGTTACCTCACCCGTCCCCTGTAA

*FIG.6C*

HH15 AMINO ACID SEQUENCE (SEQ ID NO:42)
DGYLPDWLEDNLSEGIREWWDLKPGAPKPKANQQKQDNGRGLVLPGYKYLGPFNGLDKGEPVNAADAAAL
EHDKAYDQQLKAGDNPYLRYNHADAEFQERLQEDTSFGGNLGRAVFQAKKRVLEPFGLVEEGAKTAPGKK
RPVEQSPQEPDSSSGIGKTGQQPAKKRLNFGQTGDSESVPDPQPLGEPPATPAAVGPTTMATGSGAPMAD
NNEGADGVGNASGNWHCDSTWLGDRVITTSTRTWALPTYNNHLYKQISNSTSGGSSNDNAYFGYSTPWGY
FDFNRFHCHFSPRDWQRLINNNWGFRPKRLNFKLFNIQVKEVTTNDGVTTIANNLTSTVQVFSDSEYQLP
YVLGSAHQGCLPPFPADVFMIPQYGYLTLNNGSQAVGRSSFYCLEYFPSQMLRTGNNFTFSYTFEDVPFH
SSYAHSQSLDRLMNPLIDQYLYYLNRTQNQSGSAQNKDLLFSRGSPAGMSVQPKNWLPGPCYRQQRVSKT
KTDNNNSNFTWTGASKYNLNGRESIINPGTAMASHKDDKDKFFPMSGVMIFGKESAGASNTALDNVMITD
EEEIKATNPVATERFGTVAVNLQSSSTDPATGDVHVMGALPGMVWQDRDVYLQGPIWAKIPHTDGHFHPS
PLMGGFGLKNPPPQILIKNTPVPANPPAEFSATKFASFITQYSTGQVSVEIEWELQKENSKRWNPEVQYT
SNYAKSANVDFTVDNNGLYTEPRPIGTRYLTRPL

*FIG. 6D*

HH19 CODING SEQUENCE (SEQ ID NO:43)
GCTGCCGATGGTTATCTTCCAGATTGGCTCGAGGACAACCTCTCTGAGGGCATTCGCGAGTGGTGGGCGC
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAACCCGTCAACGCAGCGGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGACCCTCAACCTCT
CGGAGAACCTCCAGCAGCGCCCTCAGTGTGGGATCTGGTACAATGGCTGCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACATGGGCCTTGCCCACCTATAACAACCACCTCTACAA
ACAAATTTCCAGCCAATCAGGAGCCTCGAACGACAATCACTACTTCGGCTACAGCACCCCCTGGGGGTAT
TTTGATTTCAACAGATTCCACTGCCATTTCTCACCACGTGACTGGCAGCGACTCATCAACAACAATTGGG
GATTCCGGCCCAAGAGACTCAACTTCAAGCTCTTCAACATCCAAGTCAAGGAGGTCACGCAGAATGATGG
CGTCACGACCATCGCTAATAACCTTACCAGCACGGTTCAAGTCTTCTCGGACTCGGAGTACCAGCTTCCG
TACGTCCTCGGCTCTGCGCACCAGGGCTGCCTCCCTCCGTTCCCGGCGGACGTGTTCATGATTCCGCAGT
ACGGCTACCTAACGCTCAACAATGGCAGCCAGGCAGTGGGACGGTCATCCTTTTACTGCCTGGAATACTT
TCCTTCGCAGATGCTGAGAACGGGCAATAACTTTACCTTCAGCTACACCTTCGAGGACGTGCCTTTCCAC
AGCAGCTACGCGCACAGCCAGAGCCTGGACCGTCTCATGAATCCTCTCATCGACCAGTACCTGTATTACC
TGAACAGAACTCAGAATCAGTCCGGAAGTGCCCAAAACAAGGACTTGCTGTTTAGCCGTGGGTCTCCAGC
TGGCATGTCTGTTCAGCCCAAAAACTGGCTACCTGGACCCTGTTATCGGCAGCAGCGCGTTTCTAAAACA
AAAACAGACAACAACAACAGCAACTTTACCTGGACTGGTGCTTCAAAATATAACCTTAATGGGCGTGAAT
CTATAATCAACCCTGGCACTGCTATGGCCTCACACAAAGACGACAAAGACAAGTTCTTTCCCATGAGCGG
TGTCATGATTTTTGGAAAAGAGAGCGCCGGAGCTTCAAACACTGCATTGGACAATGTCATGATTACAGAC
GAAGAGGAAATTAAAGCCACTAACCCTGTGGCCACCGAAAGATTTGGGACCGTGGCAGTCAATTTCCAGA
GCAGCAGCACAGACCCTGCGACCGGAGATGTGCATGCTATGGGAGCCTTACCTGGCATGGTGTGGCAAGA
TAGAGACGTGTACCTGCAGGGTCCTATTTGGGCCAAAATTCCTCACACGGATGGACACTTTCACCCGTCT
CCTCTCATGGGCGGCTTTGGACTCAAGAACCCGCCTCCTCAGATCCTCATCAAAAACACGCCTGTTCCTG
CGAATCCTCCGGCGGAGTTTTCAGCTACAAAGTTTGCTTCATTCATCACCCAATACTCCACAGGACAAGT
GAGTGTGGAAATTGAATGGGAGCTGCAGAAAGAAAACAGCAAGCGCTGGAATCCCGAAGTGCAGTATACA
TCTAACTATGCAAAATCTGCCAACGTTGATTTCACTGTGGACAACAATGGACTTTATACTGAGCCTCGCC
CCATTGGCACCCGTTACCTCACCCGTCCCCTGTAA

*FIG. 6E*

HH19 AMINO ACID SEQUENCE (SEQ ID NO:44)
DGYLPDWLEDNLSEGIREWWALKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSSVGSGTMAAGGGAPMAD
NNEGADGVGNASGNWHCDSTWLGDRVITTSTRTWALPTYNNHLYKQISSQSGASNDNHYFGYSTPWGYFD
FNRPHCHFSPRDWQRLINNNWGFRPKRLNFKLFNIQVKEVTQNDGVTTIANNLTSTVQVFSDSEYQLPYV
LGSAHQGCLPPFPADVFMIPQYGYLTLNNGSQAVGRSSFYCLEYFPSQMLRTGNNFTFSYTFEDVPHSS
YAHSQSLDRLMNPLIDQYLYYLNRTQNQSGSAQNKDLLFSRGSPAGMSVQPKNWLPGPCYRQQRVSKTKT
DNNNSNFTWTGASKYNLNGRESIINPGTAMASHKDDKDKFFPMSGVMIFGKESAGASNTALDNVMITDEE
EIKATNPVATERFGTVAVNFQSSSTDPATGDVHAMGALPGMVWQDRDVYLQGPIWAKIPHTDGHFHPSPL
MGGFGLKNPPPQILIKNTPVPANPPAEFSATKFASFITQYSTGQVSVEIEWELQKENSKRWNPEVQYTSN
YAKSANVDFTVDNNGLYTEPRPIGTRYLTRPL

*FIG. 6F*

HH27 CODING SEQUENCE (SEQ ID NO:45)
GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAAGCAGGACGACGGCCGGGGTCTGGTGCTTCC
TGGCTACAAGTACCTCGGACCCTTCAACGGACTCGACAAGGGGGAACCCGTCAACGCAGCGGACGCGGCG
GCCCTCGAGCACGACAAAGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTTTTGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTACAGGCAGTGGCGCACCAATG
GCAGACAATAACGAGGGTGCCGACGGAGTGGGTAATGCCTCAGGAAATTGGCATTGCGATTCCACATGGC
TGGGCGACAGAGTCATCACCACCAGCACCAGAACCTGGGCCCTGCCCACTTACAACAATCACCTCTACAA
GCAAATCTCCAGTGAAACTGCAGGTAGTACCAACGACAATCACTACTTTGGCTACAGCACCCCTTGGGGG
TATTTTGACTTCAACAGATTCCACTGCCACTTTTCACCACGTGACTGGCAGCGACTCATCAACAACAATT
GGGGATTCCGGCCAAGAGACTCAACTTCAAACTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGTTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCATTACCTGGCATGGTGTGGCA
AGATAGAGACGTGTACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTTACCCGTCCCCTGTAA

*FIG. 6G*

HH27 AMINO ACID SEQUENCE (SEQ ID NO:46)
DGYLPDWLEDNLSEGIREWWDLKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPFGLVEEGAKTAPGKK
RPVEQSPQEPDSSSGIGKTGQQPAKKRLNFGQTGDSESVPDQPLGEPPATPAAVGPTTMATGSGAPMAD
NNEGADGVGNASGNWHCDSTWLGDRVITTSTRTWALPTYNNHLYKQISSETAGSTNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPVGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6H*

HH35 CODING SEQUENCE (SEQ ID NO:47)
GCTGCCGATGGTTATCTTCCAGATTGGCTCGAGGACAACCTCTCTGAGGGCATTCGCGAGTGGTGGGACT
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAGCCGGTCAACGCAGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATTGGCAAGAAAGGCCAAC
AGCCCGCCAGAAAAGACTCAATTTTGGTCAGACTGGCGACTCAGAGTCAGTTCCAGACCCTCAACCTCT
CGGAGAACCTCCAGCAGCGCCCTCTAGTGTGGGATCTGGTACAGTGGCTGCAGGCGGTGGCGCACCAATG
GCAGACAATAACGAGGGCGCCGACGGAGTGGGTAATGCCTCAGGAAATTGGCATTGCGATTCCACATGGC
TGGGCGACAGAGTCATCACCACCAGCACCCGAACATGGGCCTTGCCCACCTACAACAATCACCTCTACAA
GCAAATCTCCAGTGCTTCAACGGGGGCCAGCAACGACAACCACTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AGTACGGCTACCTGACGCTCAACAATGGCAGCCAAGCCGTGGGACGTTCATCCTTTTACTGCCTGGAATA
TTTCCCTTCTCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGAATGGTGTGGCA
AGACAGAGACGTATACCTGCAGGGTCCTATTTGGGCCAAAATTCCTCACACGGATGGACACTTTCACCCG
TCTCCTCTTATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTTACCCGTCCCCTGTAA

*FIG. 6I*

HH35 AMINO ACID SEQUENCE (SEQ ID NO:48)
DGYLPDWLEDNLSEGIREWWDLKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKKGQQPARKRLNFGQTGDSESVPDPQPLGEPPAAPSSVGSGTVAAGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6J*

HH41 CODING SEQUENCE (SEQ ID NO:49)
GCTGCCGATGGTTATCTTCCAGATTGGCTCGAGGACAACCTCTCTGAGGGCATTCGCGAGTGGTGGGACT
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAGCCCGTCAACGCGGCGGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGCAACCTCGGCGAGCAGT
CTTCCAGGCCAAGAAGAGGGTTCTCGAACCTTTTGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAGCGCCCTCTAGTGTGGGACCTACTACAATGGCTTCAGGCGGTGGCGCACCAATG
GCAGACAATAACGAAGGTGCCGACGGAGTGGGTAATGCCTCAGGAAATTGGCATTGCGATTCCACATGGC
TGGGCGACAGAGTCATCACCACCAGCACCCGCACCTGGGCCTTGCCCACCTATAACAACCACCTCTACAA
GCAAATCTCCAGTGAAACTGCAGGTAGTACCAACGACAACACCTACTTCGGCTACAGCACCCCCTGGGGG
TATTTTGATTTCAACAGATTCCACTGCCACTTTTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AGTACGGCTACCTGACGCTCAACAATGGCAGCCAAGCCGTGGGACGTTCATCCTTTTACTGCCTGGAATA
CTTTCCTTCGCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATCTCC
AGAGCAGCAGCACAGACCCTGCGACCGGAGATGTGCATGTTATGGGAGCCTTACCTGGAATGGTGTGGCA
AGACAGAGACGTGTACCTGCAAGGACCCATTTGGGCCAAAATTCCTCACACGGACGGCAACTTTCACCCT
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTCACCCGTCCCCTGTAA

*FIG. 6K*

HH41 AMINO ACID SEQUENCE (SEQ ID NO:50)
DGYLPDWLEDNLSEGIREWWDLKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPFGLVEEGAKTAPGKK
RPVEQSPQEPDSSSGIGKTGQQPAKKRLNFGQTGDSESVPDQPLGEPPAAPSSVGPTTMASGGGAPMAD
NNEGADVGNASGNWHCDSTWLGDRVITTSTRTWALPTYNNHLYKQISSETAGSTNDNTYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGNFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6L*

HH45 CODING SEQUENCE (SEQ ID NO:51)
GCTGCCGATGGTTATCTTCCAGATTGGCTCGAGGACACTCTCTCTGAAGGAATAAGACAGTGGTGGAAGC
TCAAACCTGGCCCACCACCACCAAAGCCCGCAGAGCGGCATAAGGACGACAGCAGGGGTCTTGTGCTTCC
TGGGTACAAGTACCTCGGACCCTTCAACGGACTCGACAAGGGGGAACCCGTCAACGCAGCGGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAAAGACTCAATTTTGGTCAGACTGGCGACTCAGAGTCAGTCCCAGACCCTCAACCTCT
CGGAGAACCACCAGCAGCCCCCACAAGTTTGGGATCTAATACAATGGCTTCAGGCGGTGGCGCACCAATG
GCAGACAATAACGAAGGCGCCGACGAGTGGGTAATGCCTCAGGAAATTGGCATTGCGATTCCACATGGC
TGGGCGACAGAGTCATCACCACCAGCACCCGCACCTGGGCCTTGCCCACCTACAATAACCACCTCTACAA
GCAAATCTCCAGTGCTTCAACGGGGGCCAGCAACGACAACCACTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCTAAGCGACTCAACTTCAAGCTCTTCAACATTCAGGTCAAAGAGGTTACGGACAACAA
TGGAGTCAAGACCATCGCCAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGACGTGTTCATGATTCCGC
AGTACGGCTACCTGACGCTCAACAATGGCAGCCAAGCCGTGGGACGCTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATTTCC
AGAGCAGCAGCACAGACCCTGCGACCGGAGATGTGCATGCTATGGGAGCCTTACCTGGCATGGTGTGGCA
AGACAGAGACGTGTACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCGGAGTTTTCAGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTTACCCGTCCCATGTAA

FIG. 6M

HH45 AMINO ACID SEQUENCE (SEQ ID NO:52)
DGYLPDWLEDTLSEGIRQWWKLKPGPPPPKPAERHKDDSRGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPARKRLNFGQTGDSESVPDPQPLGEPPAAPTSLGSNTMASGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTDNNGVKTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPM

FIG. 6N

HH53 CODING SEQUENCE (SEQ ID NO:53)
GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAAGCAGGACGACGGCCGGGGTCTGGTGCTTCC
TGGCTACAAGTACCTCGGACCCTTCAACGGACTCGACAAGGGGGAACCCGTCAACGCGGCGGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTTCAAGAAGATACGTCTTTTGGGGGCAACCTCGGGCGAGCAGT
CTTCCAGGCCAAGAAGCGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGAAAGGCCAAC
AGCCCGCCAGAAAAAGACTCAATTTTGGTCAGACTGGCGACTCAGAGTCAGTCCCCGACCCTCAACCTCT
CGGAGAACCTCCAGCAGCGCCCTCTAGTGTGGGATCTGGTACAGTGGCTGCAGGCGGTGGCGCACCAATG
GCAGACAATAACGAAGGTGCCGACGAGTGGGTAATGCCTCAGGAAATTGGCATTGCGATTCCACATGGC
TGGGCGACAGAGTCATTACCACCAGCACCCGAACCTGGGCCCTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCTAAGCGACTCAACTTCAAGCTCTTCAACATTCAGGTCAAAGAGGTTACGGACAACAA
TGGAGTCAAGACCATCGCCAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCTTCTCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGTGGGTCTCC
AGTTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACTGTGGCAGTCAATTTCC
AGAGCAGCAGCACAGACCCTGCGACCGGAGATGTGCATGTTATGGGAGCATTACCTGGCATGGTGTGGCA
AGATATAGACGTGTACCTGCAGGGTCCCATTTGGGCCAAAATTCCTCACACGGATGGCACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTCAGTAT
ACATCTAACTATGCAAATCTGCCAACGTTGATTTTACTGTGGACAACAATGGACTTTATACTGAGCCTC
GCCCCATTGGCACCCGTTACCTCACCCGTCCCCTGTAA

FIG. 6O

HH53 AMINO ACID SEQUENCE (SEQ ID NO:54)
DGYLPDWLEDNLSEGIREWWDLKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKKGQQPARKRLNFGQTGDSESVPDPQPLGEPPAAPSSVGSGTVAAGGGAPMAD
NNEGADGVGNASGNWHCDSTWLGDRVITTSTRTWALPTYNNHLYKQISSETAGSTNDNTYFGYSTPWGYF
DFNRFHCHFSPRDWQRLINNNWGFRPKRLNFKLFNIQVKEVTDNNGVKTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPVGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHVMGALPGMVWQDIDVYLQGPIWAKIPHTDGHFHPSP
LMGGFGLKNPPPQILIKNTPVPANPPAEFSATKFASPITQYSTGQVSVEIEWELQKENSKRWNPEVQYTS
NYAKSANVDFTVDNNGLYTEPRPIGTRYLTRPL

FIG. 6P

HH67 CODING SEQUENCE (SEQ ID NO:55)
GCTGCCGATGGTTATCTTCCAGATTGGCTCGAGGACAACCTCTCTGAGGGCATTCGCGAGTGGTGGGACC
TGAAACCTGGAGCCCCGAAACCCAAAGCCAACCAGCAAAAGCAGGACAACGGCCGGGGTCTGGTGCTTCC
TGGCTACAAGTACCTCGGACCCTTCAACGGACTCGACAAGGGGGAGCCGGTCAACGCAGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAAAGACTAAATTTCGGTCAGACTGGCGACTCAGAGTCAGTTCCAGACCCTCAACCTCT
CGGAGAACCTCCAGCAACCCCCGCTGCTGTGGGACCTAATACAATGGCTTCAGGTGGTGGCGCACCAATG
GCAGACAATAACGAAGGCGCCGACGGAGTGGGTAATGCCTCAGGAAATTGGCATTGCGATTCCACATGGA
TGGGCGACAGAGTCATCACCACCAGCACCCGCACCTGGGCCTTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCACTTCTCACCACGTGACTGGCAGCGACTCATCAACAACAATT
GGGGATTCCGGCCAAGAGACTCAACTTCAAACTCTTCAACATCCAAGTCAAGGAGGTCACGACGAATGA
CGGCGTTACGACCATCGCTAATAACCTTACCAGCACGGTTCAAGTCTTCTCGGACTCGGAGTACCAGCTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAGGCAGTGGGACGGTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATCAAAGCCACTAACCCCGTGGCCACCGAAAGATTTGGGACCGTGGCAGTCAATCTCC
AGAGCAGCAGCACAGACCCTGCGACCGGAGATGTGCATGTTATGGGAGCCTTACCTGGAATGGTGTGGCA
AGATAGAGACGTGTACCTGCAGGGTCCCATTTGGGCCAAAATTCCTCACACAGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

*FIG. 6Q*

HH67 AMINO ACID SEQUENCE (SEQ ID NO:56)
DGYLPDWLEDNLSEGIREWWDLKPGAPKPKANQQKQDNGRGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPARKRLNFGQTGDSESVPDPQPLGEPPATPAAVGPNTMASGGGAPMAD
NNEGADGVGNASGNWHCDSTWMGDRVITTSTRTWALPTYNNHLYKQISSETAGSTNDNTYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6R*

HH68 CODING SEQUENCE (SEQ ID NO:57)
GCTGCCGATGGTTATCTTCCAGATTGGCTCGAGGACAACCTTTCTGAAGGCATTCGTGAGTGGTGGGCTC
TGAAACCTGGAGTCCCTCAACCCAAAGCGAACCAACAACACCAGGACAACCGTCGGGGTCTTGTGCTTCC
GGGTTACAAATACCTCGGACCCGGTAACGGACTCGACAAAGGAGAGCCGGTCAACGAGGCAGACGCCGCG
GCCCTCGAGCACGACAAAGCCTACGACCAGCAGCTCAAGGCCGGTGACAACCCGTACCTCAAGTACAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGACCCTCAACCTCT
CGGAGAACCTCCAGCAGCGCCCTCTAGTGTGGGATCTGGTACAGTGGCTGCAGGCGGTGGCGCACCAATG
GCAGACAATAACGAGGGTGCCGACGGAGTGGGTAATGCCTCAGGAAATTGGCATTGCGATTCCACATGGC
TGGGCGACAGAGTCATCACCACCAGCACCCGAACATGGGCCTTGCCCACCTACAACAATCACCTCTACAA
GCAAATCTCCAGTGCTTCAACGGGGCCAGCAACGACAACCACTACTTCGGCTACAGCACCCCTGGGGG
TATTTTGACTTTAACAGATTCCACTGCCACTTTTCACCACGTGACTGGCAGCGACTCATCAACAACAATT
GGGGATTCCGGCCCAAGAGACTCAACTTCAAACTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGCATGGTGTGGCA
AGATAGAGACGTGTACCTGCAGGGTCCCATTTGGGCCAAAATTCCTCACACAGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCCAATTATGCAAAATCTGCCAACGTTGATTTACTGTGGACAACAATGGACTTTATACTGAGCCTC
GCCCCATTGGCACCCGTTACCTCACCCGTCCCCTGTAA

FIG. 6S

HH68 AMINO ACID SEQUENCE (SEQ ID NO:58)
DGYLPDWLEDNLSEGIREWWALKPGVPQPKANQQHQDNRRGLVLPGYKYLGPGNGLDKGEPVNEADAAAL
EHDKAYDQQLKAGDNPYLKYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSSVGSGTVAAGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6T

HH75 CODING SEQUENCE (SEQ ID NO:59)
GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAAGCAGGACGACGGCCGGGGTCTGGTGCTTCC
TGGCTACAAGTACCTCGGACCCTTCAACGGACTCGACAAGGGAGAGCCCGTCAACGCGGCGGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTTCCAGACCCTCAACCTCT
CGGAGAACCTCCAGCAGCGCCCTCTGGTGTGGGACCTAATACAATGGCTGCAGGCGGTGGCGCACCAGTG
GCAGACAATAACGAAGGCGCCGACGGAGTGGGTAATGCCTCAGGAAATTGGCATTGCGATTCCACATGGA
TGGGCGACAGAGTCATCACCACCAGCACCCGCACCTGGGCCTTGCCCACCTACAATAACCACCTCTACAA
GCAAATCTCCAGTGCTTCAACGGGGGCCAGCAACGACAACCACTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTAACGCTCAACAATGGCAGCCAGGCAGTGGGACGGTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGTTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATTTCC
AGAGCAGCAGCACAGACCCTGCGACCGGAGATGTGCATGCTATGGGAGCCTTACCTGGCATGGTGTGGCA
AGACAGAGACGTGTACCTGCAGGGTCCCATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCGGAGTTTTCAGCTACAAAGTTTGCTTCATTCATCACCCAATACTCCACAGGACA
AGTGAGCGTGGAGATTGAATGGGAGCTGCAGAAAGAAAACAGCAAACGCTGGAATCCCGAAGTGCAGTAT
ACATCTAACTATGCAAATCTGCCAACGTTGATTTTACTGTGGACAACAATGGACTTTATACTGAGCCTC
GCCCCATTGGCACCCGTTACCTTACCCGTCCCCTGTAA

FIG. 6U

HH75 AMINO ACID SEQUENCE (SEQ ID NO:60)
DGYLPDWLEDNLSEGIREWWDLKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSGVGPNTMAAGGAPVAD
NNEGADGVGNASGNWHCDSTWMGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPVGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6V

HH87 CODING SEQUENCE (SEQ ID NO:61)
GCTGCCGATGGTTATCTTCCAGATTGGCTCGAGGACAACCTTTCTGAAGGCATTCGTGAGTGGTGGGCTC
TGAAACCTGGAGTCCCTCAACCCAAAGCGAACCAACAACACCAGGACAACCGTCGGGGTCTGGTGCTTCC
GGGTTACAAATACCTTGGACCCGGCAACGGACTCGACAAGGGAGAGCCGGTCAACGAGGCAGACGCCGCG
GCCCTCGAGCACGACAAGGCCTACGACCAGCAGCTCAAGGCCGGTGACAACCCCTACCTCAAGTACAACC
ACGCCGACGCGGAGTTCCAGCAGCGGCTTCAAGAAGATACGTCTTTTGGGGGCAACCTCGGGCGAGCAGT
CTTCCAGGCCAAGAAGCGGGTTCTTGAACCTCTTGGTCTGGTTGAGCAAGCGGGTGAGACGGCTCCTGGA
AAGAAACGTCCGGTAGAGCAGTCGCCACAAGAGCCAGACTCCTCCTCGGGCATTGGCAAGACAGGCCAGC
AGCCCGCTAAAAAGAGACTCAATTTCGGTCAGACTGGCGACTCAGAGTCAGTCCCCGATCCACAACCTCT
CGGAGAACCTCCAGCAACCCCCGCTGCTGTGGGACCTACTACAATGGCTACAGGCAGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGCACCTGGGCCTTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACGACCATCGCCAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATCAAAGCCACTAACCCCGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTTACCCGTCCCCTGTAA

FIG. 6W

HH87 AMINO ACID SEQUENCE (SEQ ID NO:62)
DGYLPDWLEDNLSEGIREWWALKPGVPQPKANQQHQDNRRGLVLPGYKYLGPGNGLDKGEPVNEADAAAL
EHDKAYDQQLKAGDNPYLKYNHADAEFQQRLQEDTSFGGNLGRAVFQAKKRVLEPLGLVEQAGETAPGKK
RPVEQSPQEPDSSSGIGKTGQQPAKKRLNFGQTGDSESVPDPQPLGEPPATPAAVGPTTMATGSGAPMAD
NNEGADGVGNASGNWHCDSTWLGDRVITTSTRTWALPTYNNHLYKQISSETAGSTNDNTYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6X

HH98 CODING SEQUENCE (SEQ ID NO:63)
GCTGCCGATGGTTATCTTCCAGATTGGCTCGAGGACAACCTCTCTGAGGGCATTCGCGAGTGGTGGGACT
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGAGAGCCGGTCAACGAGGCAGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAGCGCCCTCTAGTGTGGGATCTGGTACAGTGGCTGCAGGCGGTGGCGCACCAATG
GCAGACAATAACGAGGGTGCCGACGGAGTGGGTAATGCCTCAGGAAATTGGCATTGCGATTCCACATGGC
TGGGCGACAGAGTCATCACCACCAGCACCCGAACCTGGGCCTTGCCCACCTACAATAACCACCTCTACAA
GCAAATCTCCAGTGCTTCAACGGGGCCAGCAACGACAACCACTACTTCGGCTACAGCACCCCTGGGGG
TATTTTGATTTCAACAGATTCCACTGCCATTTCTCACCACGTGACTGGCAGCGACTCATTAACAACAACT
GGGGATTCCGGCCTAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATCAAAGCCACTAACCCTGTGGCCACCGAAAGATTTGGGACCGTGGCAGTCAATTTCC
AGAGCAGCAGCACAGACCCTGCGACCGGAGATGTGCATGCTATGGGAGCATTACCTGGAATGGTGTGGCA
AGACAGAGACGTATACCTGCAGGGTCCTATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCGGAGTTTTCAGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6Y

HH98 AMINO ACID SEQUENCE (SEQ ID NO:64)
DGYLPDWLEDNLSEGIREWWDLKPGAPKPKANQQKQDDGRGLVLPGYKYLGPFNGLDKGEPVNEADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSSVGSGTVAAGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6Z

MH4 CODING SEQUENCE (SEQ ID NO:65)
GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAAGCAGGACAACGGCCGGGGTCTGGTGCTTCC
TGGCTACAAGTACCTCGGACCCTTCAACGGACTCGACAAGGGGGAGCCCGTCAACGCGGCGGACGCAGCG
GCCCTGGAGCACGACAAGGCCTACGACCAGCAGCTCAAAGCGGGAGACAACCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGAAAGGCCAAC
AGCCCGCCAGAAAAAGACTCAATTTTGGTCAGACTGGCGACTCAGAGTCAGTTCCAGACCCTCAACCTCT
CGGAGAACCTCCAGCAGCGCCCTCTGGTGTGGGACCTAATACAATGGCTTCAGGTGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCAGAACCTGGGCCCTGCCCACCTACAACAACCACCTCTACAA
ACAAATTTCCAGTGCTTCAACGGGGCCAGCAACGACAACCACTACTTCGGCTACAGCACCCCCTGGGGG
TATTTTGATTTCAACAGATTCCACTGCCACTTCTCACCACGTGACTGGCAGCGACTCATCAACAACAACT
GGGGATTCCGGCCCAAGAGACTCAACTTCAAACTCTTCAACATCCAAGTCAAGGAGGTCACGACGAATGA
CGGCGTTACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAATACCTGTATT
ACCTGAACAGAACTCAGAATCAGTCCGGAAGTGCCCAAAACAAGGACTTGCTGTTTAGCCGAGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGAAAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATCAAAGCCACTAACCCCGTGGCCACCGAAAGATTTGGGACCGTGGCAGTCAATCTCC
AGAGCAGCAGCACAGACCCTGCGACCGGAGATGTGCATGTTATGGGAGCCTTACCTGGAATGGTGTGGCA
AGACAGAGACGTATACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAACAGCAAACGCTGGAATCCCGAAGTGCAGTAT
ACATCTAACTATGCAAATCTGCCAACGTTGATTTCACTGTGGACAACAATGGACTTTATACTGAGCCTC
GCCCCATTGGCACCCGTTACCTCACCCGTCCCCTGTAA

FIG. 6AA

MH4 AMINO ACID SEQUENCE (SEQ ID NO:66)
DGYLPDWLEDNLSEGIREWWDLKPGAPKPKANQQKQDNGRGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKKGQQPARKRLNFGQTGDSESVPDPQPLGEPPAAPSGVGPNTMASGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDEKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6BB

MH18 CODING SEQUENCE (SEQ ID NO:67)
GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAATCAGGACAACGGCCGGGGTCTGGTGCTTCC
TGGCTACAAATACCTTGGACCCGGCAACGGACTCGACAAGGGGGAGCCCGTCAACGCGGCGGACGCAGCG
GCCCTGGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGACCCACAACCTCT
CGGAGAACCTCCAGCAACCCCCGCTGCTGTGGGACCTACTACAATGGCTGCAGGTGGTGGCGCACCAATG
GCAGACAATAACGAAGGCGCCGACGGAGTGGGTAGTTCCTCGGGAAATTGGCATTGCGATTCCACATGGA
TGGGCGACAGAGTCATCACCACCAGCACCCGAACCTGGGCCCTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGATTTCAACAGATTCCACTGCCATTTCTCACCACGTGACTGGCAGCGACTCATCAACAACAACT
GGGGATTCCGGCCCAAGAAACTGCGGTTCAAGCTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTCGAGTACGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAATTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6CC

MH18 AMINO ACID SEQUENCE (SEQ ID NO:68)
DGYLPDWLEDNLSEGIREWWDLKPGAPKPKANQQNQDNGRGLVLPGYKYLGPGNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPATPAAVGPTTMAAGGGAPMAD
NNEGADGVGSSSGNWHCDSTWMGDRVITTSTRTWALPTYNNHLYKQISSETAGSTNDNTYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEYVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6DD

MH21 CODING SEQUENCE (SEQ ID NO:69)
GCTGCCGATGGTTATCTTCCAGATTGGCTCGAGGACAACCTCTCTGAGGGCATTCGCGAGTGGTGGGACC
TGAAACCTGGAGCCCCGAAACCCAAGGCAAATCAACAACATCAGGACAACGCTCGGGGTCTTGTGCTTCC
GGGTTACAAATACCTCGGACCCTTCAACGGACTCGACAAGGGGGAGCCGGTCAACGCAGCGGACGCGGCA
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTTTTGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGAAAGGCCAAC
AGCCCGCCAGAAAAAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAAGGTGCCGACGGAGTGGGTAGTTCCTCGGGAAATTGGCATTGCGATTCCACATGGC
TGGGCGACAGAGTCATCACCACCAGCACCCGCACCTGGGCCTTGCCCACCTACAATAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCACTTCTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTGCCTCCGTTCCCGGCGGACGTGTTCATGATTCCGC
AATACGGCTACCTGACGCTCAACAATGGCAGTCAGTCTGTGGGACGTTCCTCCTTCTACTGCCTGGAGTA
CTTCCCCTCTCAGATGCTGAGAACGGGCAACAACTTTGAGTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCTAACTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6EE

MH21 AMINO ACID SEQUENCE (SEQ ID NO:70)
DGYLPDWLEDNLSEGIREWWDLKPGAPKPKANQQHQDNARGLVLPGYKYLGPFNGLDKGEPVNAADAAAL
EHDKAYDQQLKAGDNPYLRYNHADAEFQERLQEDTSFGGNLGRAVFQAKKRVLEPFGLVEEGAKTAPGKK
RPVEQSPQEPDSSSGIGKKGQQPARKRLNFGQTGDSESVPDPQPLGEPPATPAAVGPTTMASGGGAPMAD
NNEGADGVGSSSGNWHCDSTWLGDRVITTSTRTWALPTYNNHLYKQISSETAGSTNDNTYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQSVGRSSFYCLEYFPSQMLRTGNNFEFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6FF

MH31 CODING SEQUENCE (SEQ ID NO:71)

GCTGCCGATGGTTATCTTCCAGATTGGCTCGAGGACAACCTCTCTGAGGGCATTCGCGAGTGGTGGGACC
TGAAACCTGGAGCCCCGAAACCCAAAGCCAACCAGCAAAAGCAGGACAACCGTCGGGGTCTGGTGCTTCC
GGGTTACAAATACCTCGGACCCGGTAACGGACTCGACAAAGGGGAGCCCGTCAACGCGGCGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTCGGTCAGACTGGCGACTCAGAGTCAGTCCCCGACCCTCAACCTCT
CGGAGAACCTCCAGCAGCGCCCTCTGGTGTGGGACCTAATACAATGGCTGCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACATGGGCCTTGCCCACCTACAATAACCACCTCTACAA
GCAAATCTCCAGTGAAACTGCAGGTAGTACCAACGACAACACCTACTTCGGCTACAGCACCCCTGGGGG
TATTTTGACTTTAACAGATTCCACTGCCACTTTTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
CGGCGTTACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTCTTCATGATTCCTC
AGTACGGCTACCTGACTCTCAACAATGGCAGTCAGTCTGTGGGACGTTCCTCCTTCTACTGCCTGGAATA
TTTCCCCTCTCAGATGCTGAGAACGGGCAACAACTTTGAGTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCCATCATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCATTACCTGGCATGGTGTGGCA
AGATAGAGACGTGTACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCTAACTATGCAAAATCTGCCAACGTTGATTTTACTGTGGACAACAATGGACTTTATACTGAGCCTC
GCCCCATTGGCACCCGTTACCTCACCCGTCCCCTGTAA

FIG. 6GG

MH31 AMINO ACID SEQUENCE (SEQ ID NO:72)

DGYLPDWLEDNLSEGIREWWDLKPGAPKPKANQQKQDNRRGLVLPGYKYLGPGNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPARKRLNFGQTGDSESVPDPQPLGEPPAAPSGVGPNTMAAGGGAPMAD
NNEGADGVGNASGNWHCDSTWLGDRVITTSTRTWALPTYNNHLYKQISSETAGSTNDNTYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQSVGRSSFYCLEYFPSQMLRTGNNFEFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6HH

MH39 CODING SEQUENCE (SEQ ID NO:73)

GCTGCCGATGGTTATCTTCCAGATTGGCTCGAGGACAACCTCTCTGAGGGCATTCGCGAGTGGTGGGCGC
TGCAACCTGGAGCCCCTCAACCCAAGGCAAATCAACAACATCAAGACAACGCTCGAGGTCTTGTGCTTCC
GGGTTACAAATACCTTGGACCCGGCAACGGACTCGACAAGGGGGAGCCCGTCAACGCGGCGGACGCGGCG
GCCCTCGAGCACGACAAGGCCTACGACCAGCAGCTGCAGGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAAC
AGCCCGCCAGAAAAAGACTCAATTTTGGTCAGACTGGCGACTCAGAGTCAGTCCCAGACCCTCAACCTCT
CGGAGAACCACCAGCAGCCCCCACAAGTTTGGGATCTAATACAATGGCTTCAGGCGGTGGCGCACCAATG
GCAGACAATAACGAGGGTGCCGATGGAGTGGGTAATTCCTCAGGAAATTGGCATTGCGATTCCACATGGC
TGGGCGACAGAGTCATCACCACCAGCACCAGAACCTGGGTCTTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCACTTTTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
CGGCGTTACGACCATCGCTAATAACCTTACCAGCACGGTTCAAGTCTTCTCGGACTCGGAGTACCAGCTG
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAAGCCGTGGGACGTTCATCCTTTTACTGCCTGGAATA
TTTCCCTTCTCAGATGCTGAGAACGGGCAACAACTTTGAGTTCAGCTACACTTTTGAGGACGTTCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACTGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCATTTGGGCCAAAATTCCTCACACAGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6II

MH39 AMINO ACID SEQUENCE (SEQ ID NO:74)

DGYLPDWLEDNLSEGIREWWALQPGAPQPKANQQHQDNARGLVLPGYKYLGPGNGLDKGEPVNAADAAAL
EHDKAYDQQLQAGDNPYLRYNHADAEFQERLQEDTSFGGNLGRAVFQAKKRVLEPLGLVEEGAKTAPGKK
RPVEQSPQEPDSSSGIGKTGQQPARKRLNFGQTGDSESVPDPQPLGEPPAAPTSLGSNTMASGGGAPMAD
NNEGADGVGNSSGNWHCDSTWLGDRVITTSTRTWVLPTYNNHLYKQISSETAGSTNDNTYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFEFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6JJ

MH43 CODING SEQUENCE (SEQ ID NO:75)
GCTGCCGATGGTTATCTTCCAGATTGGCTCGAGGACAACCTCTCTGAGGGCATTCGCGAGTGGTGGGACT
TGAAACCTGGAGCCCCGAAGCCCAAAGCCAACCAGCAAAAGCAGGACAACGCTCGGGGTCTTGTGCTTCC
GGGTTACAAGTACCTCGGACCCTTCAACGGACTCGACAAAGGAGAGCCCGTCAACGCGGCGGATGCAGCG
GCCCTGGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATTGGCAAGACAGGCCAGC
AGCCCGCTAAAAAGAGACTCAATTTTGGTCAGACTGGCGACTCAGAGTCAGTTCCAGACCCTCAACCTCT
CGGAGAACCTCCAGCAGCGCCCTCTGGTGTGGGACCTAATACAATGGCTGCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACATGGGCCTTGCCCACCTATAACAACCACCTCTACAA
GCAAATCTCCAGTGCTTCAACGGGGCCAGCAACGACAACCACTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCAAGAGACTCAACTTCAAGCTCTTCAACATCCAAGTCAAGGAGGTCACGACGAATGA
TGGCGTTACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGGTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAATTTTACCTGGACTGGTGCTTCAAAATATAACCTTAATGGGCGTG
AATCCATCATCAACCCTGGCACTGCTATGGCCTCACACAAAGACGAAAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATTTCC
AGAACAGCAGCACAGACCCTGCGACCGGAGATGTGCATGTTATGGGAGCCTTACCTGGAATGGTGTGGCA
AGACAGAGACGTATACCTGCAGGGTCCTATTTGGGCCAAAATTCCTCACACGGATGGCACTTTCACCCG
TCTCCTCTTATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6KK

MH43 AMINO ACID SEQUENCE (SEQ ID NO:76)
DGYLPDWLEDNLSEGIREWWDLKPGAPKPKANQQKQDNARGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSGVGPNTMAAGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDEKDKFFPMSGVMIFGKESAGASNTALDNVMITDE
EEIKATNPVATERFGTVAVNFQNSSTDPATGDVHVMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6LL

MH47 CODING SEQUENCE (SEQ ID NO:77)
GCTGCCGATGGTTATCTTCCAGATTGGCTCGAGGACAACCTCTCTGAGGGCATTCGCGAGTGGTGGGACT
TGAAACCTGGAGCCCCGAAACCCAAGGCAAATCAACAACATCAGGACAACGCTCGGGGTCTTGTGCTTCC
GGGTTACAAATACCTCGGACCCGGCAACGGACTCGACAAGGGGGAGCCCGTCAACGCGGCGGATGCAGCG
GCCCTCGAGCACGACAAGGCCTACGACCAGCAGCTCAAGGCCGGAGACAACCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTTCCAGACCCTCAACCTCT
CGGAGAACCACCAGCAGCCCCCACAAGTTTGGGATCTAATACAATGGCTTCAGGCGGTGGCGCACCAATG
GCAGACAATAACGAGGGTGCCGATGGAGTGGGTAATGCCTCAGGAAATTGGCATTGCGATTCCACATGGC
TGGGCGACAGAGTCATCACCACCAGCACCCGAACATGGGCCTTGCCCACCTACAATAACCACCTCTACAA
GCAAATCTCCAGTGCTTCAACGGGGCCAGCAACGACAACCACTACTTCGGCTACAGCACCCCCTGGGGG
TATTTTGATTTCAACAGATTCCACTGCCACTTTTCACCACGTGACTGGCAGCGACTCATCAACAACAATT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCTTCTCAGATGCTGAGAACGGGCAATAACTTTACCTTCAGCTACACCTTTGAGGACGTGCCTTTC
CACAGCAGCTACGCGCACAGCCAGAGCCTGGACCGGCTGATGAATCCTCTCATCGACCAATACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAATTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATCACA
GACGAAGAGGAAATTAAAGCCACTAACCCCGTGGCCACCGAAAGATTTGGGACTGTGGCAGTCAATTTCC
AGAGCAGCAGCACAGACCCTGCGACCGGAGATGTGCATGTTATGGGAGCATTACCTGGCATGGTGTGGCA
AGATAGAGACGTATACCTGCAGGGTCCATTTGGGCCAAAATTCCTCACACAGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

*FIG. 6MM*

MH47 AMINO ACID SEQUENCE (SEQ ID NO:78)
DGYLPDWLEDNLSEGIREWWDLKPGAPKPKANQQHQDNARGLVLPGYKYLGPGNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPTSLGSNTMASGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDFFPMSGVMIFGKESAGASNTALDNVMITDE
EEIKATNPVATERFGTVAVNFQSSSTDPATGDVHVMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6NN*

MH58 CODING SEQUENCE (SEQ ID NO:79)
GCTGCCGATGGTTATCTTCCAGATTGGCTCGAGGACAACCTCTCTGAAGGCATTCGCGAGTGGTGGGCTC
TGAAACCTGGAGTCCCTCAACCCAAAGCGAATCAACAACATCAGGACAACGCTCGGGGTCTTGTGCTTCC
GGGTTACAAATACCTCGGACCCTTCAACGGACTCGACAAGGGGGAGCCCGTCAACGCGGCGGACGCAGCG
GCCCTGGAGCACGACAAGGCCTACGACCAGCAGCTCAAGGCCGGAGACAACCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGAAAGGCCAGC
AGCCCGCTAAAAAGAGACTCAATTTTGGTCAGACTGGCGACTCAGAGTCAGTCCCAGACCCTCAACCTCT
CGGAGAACCTCCAGCAACCCCCGCTGCTGTGGGATCTACTACAATGGCTGCAGGCGGTGGCGCACCAATG
GCAGACAATAACGAGGGTGCCGACGGAGTGGGTAATGCCTCAGGAAATTGGCATTGCGATTCCACATGGA
TGGGCGACAGAGTCATCACCACCAGCACCCGCACCTGGGCCCTGCCCACCTACAACAACCACCTCTACAA
GCAAATCTCCAGTGCTTCAACGGGGCCAGCAACGACAACCACTACTTCGGCTACAGCACCCCCTGGGGG
TATTTTGATTTCAACAGATTCCACTGCCATTTCTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGCTCCTCCTTCTACTGCCTGGAATA
CTTTCCTTCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGAATGGTGTGGCA
AGACAGAGACGTGTACCTGCAGGGTCCCATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAATACTCCACAGGACA
AGTGAGTGTGGAAATTGAATGGGAGCTGCAGAAAGAAAACAGCAAACGCTGGAATCCCGAAGTGCAGTAT
ACATCTAACTATGCAAATCTGCCAACGTTGATTTCACTGTGGACAACAATGGACTTTATACTGAGCCTC
GCCCCATTGGCACCCGTTACCTTACCCGTCCCCTGTAA

FIG. 6OO

MH58 AMINO ACID SEQUENCE (SEQ ID NO:80)
DGYLPDWLEDNLSEGIREWWALKPGVPQPKANQQHQDNARGLVLPGYKYLGPFNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKKGQQPAKKRLNFGQTGDSESVPDPQPLGEPPATPAAVGSTTMAAGGGAPMAD
NNEGADGVGNASGNWHCDSTWMGDRVITTSTRTWALPTYNNHLYKQISSASTGASNDNHYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6PP

MH63 CODING SEQUENCE (SEQ ID NO:81)

GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAAGCAGGACGACGGCCGGGGTCTGGTGCTTCC
TGGCTACAAGTACCTCGGACCCTTCAACGGACTCGACAAGGGGGAACCCGTCAACGCAGCGGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTTGGCAGAGCAGT
CTTCCAGGCCAAGAAGAGGGTTCTCGAACCTTTTGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGACCCTCAACCTCT
CGGAGAACCTCCAGCAGCGCCCTCTGGTGTGGGACCTAATACAATGGCTGCAGGCGGTGGCGCACCAATG
GCAGACAATAACGAAGGTGCCGACGGAGTGGGTAATTCCTCGGGAAATTGGCATTGCGATTCCACATGGA
TGGGCGACAGAGTCATTACCACCAGCACCCGAACCTGGGCCCTGCCCACCTATAACAACCACCTCTACAA
GCAAATCTCCAGTGCTTCAACGGGGGCCAGCAACGACAACCACTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCCAAGAGACTCAACTTCAAGCTCTTCAACATCCAGGTCAAGGAGGTCACGCAGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAGGCAGTGGGACGTTCATCCTTTTACTGCCTGGAATA
TTTCCCTTCTCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAGACGACAAAGACAAGTTCTTTCCCATGAG
CGGTGTCATGATTTTTGGAAAAGAGAGCGCCGGAGCTTCAAACACTGCATTGGACAATGTCATGATCACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCATTACCTGGCATGGTGTGGCA
AGATAGAGACGTGTACCTGCAGGGTCCCATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCGGAGTTTTCAGCTACAAAGTTTGCTTCATTCATCACCCAGTATTCCACAGGACA
AGTGAGCGTGGAGATTGAATGGGAGCTGCAGAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

*FIG. 6QQ*

MH63 AMINO ACID SEQUENCE (SEQ ID NO:82)

DGYLPDWLEDNLSEGIREWWDLKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPFGLVEEGAKTAPGKK
RPVEQSPQEPDSSSGIGKTGQQPAKKRLNFGQTGDSESVPDPQPLGEPPAAPSGVGPNTMAAGGGAPMAD
NNEGADGVGNSSGNWHCDSTWMGDRVITTSTRTWALPTYNNHLYKQISSASTGASNDNHYFGYSTPWGYF
DFNRFHCHFSPRDWQRLINNNWGFRPKRLNFKLFNIQVKEVTQNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6RR*

MH71 CODING SEQUENCE (SEQ ID NO:83)
GCTGCCGATGGTTATCTTCCAGATTGGCTCGAGGACAACCTTTCTGAGGGCATTCGCGAGTGGTGGGACT
TGAAACCTGGAGCCCCTCAACCCAAAGCGAACCAACAACACCAGGACAACCGTCGGGGTCTTGTGCTTCC
GGGTTACAAATACCTCGGACCCGGCAACGGACTCGACAAAGGAGAGCCCGTCAACGCAGCAGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATTACCACCAGCACCCGAACATGGGCCTTGCCCACCTATAACAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCACTTCTCACCACGTGACTGGCAGCGACTCATCAACAACAATT
GGGGATTCCGGCCTAAGCGACTCAACTTCAAGCTCTTCAACATCCAGGTCAAGGAGGTCACGACGAATGA
TGGCGTCACAACCATCGCTAATAACCTTACCAGCACGGTTCAAGTCTTCTCGGACTCGGAGTACCAGCTG
CCGTACGTCCTCGGCTCTGCGCACCAGGGCTGCCTCCCTCCGTTCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAACAACTTTACCTTCAGCTACACCTTTGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGATAGAGACGTATACCTGCAGGGTCCTATTTGGGCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

*FIG. 6SS*

MH71 AMINO ACID SEQUENCE (SEQ ID NO:84)
DGYLPDWLEDNLSEGIREWWDLKPGAPQPKANQQHQDNRRGLVLPGYKYLGPGNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPATPAAVGPTTMASGGGAPMAD
NNEGADGVGNASGNWHCDSTWLGDRVITTSTRTWALPTYNNHLYKQISSETAGSTNDNTYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6TT*

MH74 CODING SEQUENCE (SEQ ID NO:85)
GCTGCCGATGGTTATCTTCCAGATTGGCTCGAGGACAACCTCTCTGAGGGCATTCGCGAGTGGTGGGCGC
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAGCCCGTCAACGCAGCGGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGATCCTTGAGCCTCTTGGTCTGGTTGAGGAAGCAGCTAAAACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAAGGCGCCGACGGAGTGGGTAATGCCTCAGGAAATTGGCATTGCGATTCCACATGGA
TGGGCGACAGAGTCATCACCACCAGCACCCGAACATGGGCCTTGCCCACCTATAACAACCACCTCTACAA
GCAAATCTCCAGTGCTTCAACGGGGCCAGCAACGACAACCACTACTTCGGCTACAGCACCCCCTGGGGG
TATTTTGATTTCAACAGATTCCACTGCCACTTCTCACCACGTGACTGGCAGCGACTCATCAACAACAATT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAGGCAGTGGGACGGTCATCCTTTTACTGCCTGGAATA
TTTCCCATCGCAGATGCTGAGAACGGGCAACAACTTTGAGTTCAGCTACACTTTTGAGGACGTTCCTTTC
CACAGCAGCTACGCTCACAGCCAGAGTCTGGACCGTCTCATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCCGTGGCCACCGAAAGATTTGGGACTGTGGCAGTCAATTTCC
AGAGCAGCAGCACAGACCCTGCGACCGGAGATGTGCATGCTATGGGAGCATTACCTGGCATGGTGTGGCA
AGACAGAGACGTGTACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTCACTGTGGACAACAATGGACTTTATACTGAGCCTC
GCCCCATTGGCACCCGTTACCTCACCCGTCCCCTGTAA

FIG. 6UU

MH74 AMINO ACID SEQUENCE (SEQ ID NO:86)
DGYLPDWLEDNLSEGIREWWALKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRILEPLGLVEEAAKTAPGKK
RPVEQSPQEPDSSSGIGKTGQQPAKKRLNFGQTGDSESVPDPQPLGEPPATPAAVGPTTMASGGGAPMAD
NNEGADGVGNASGNWHCDSTWMGDRVITTSTRTWALPTYNNHLYKQISSASTGASNDNHYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFEFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6VV

MH78 CODING SEQUENCE (SEQ ID NO:87)
GCTGCCGATGGTTATCTTCCAGATTGGCTCGAGGACAACCTCTCTGAGGGCATTCGCGAGTGGTGGGCGC
TGAAACCTGGAGCCCCGAAACCCAAAGCCAACCAGCAAAAGCAGGACGACGGCCGGGGTCTGGTGCTTCC
TGGCTACAAGTACCTCGGACCCTTCAACGGACTCGACAAGGGGGAACCCGTCAACGCAGCGGACGCGGCA
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTTTTGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTCGGTCAGACTGGCGACTCAGAGTCAGTCCCCGACCCTCAACCTCT
CGGAGAACCTCCAGCAACCCCCGCTGCTGTGGGACCTAATACAATGGCTGCAGGCGGTGGCGCACCAATG
GCAGACAATAACGAAGGTGCCGACGGAGTGGGTAATGCCTCAGGAAATTGGCATTGCGATTCCACATGGC
TGGGCGACAGAGTCATCACCACCAGCACCCGAACCTGGGCCTTGCCCACCTACAATAACCACCTCTACAA
GCAAATCTCCAGTGCTTCAACGGGGGCCAGCAACGACAACCACTACTTTGGCTACAGCACCCCCTGGGGG
TATTTTGACTTTAACAGATTCCACTGCCACTTCTCACCACGTGACTGGCAGCGACTCATCAACAACAATT
GGGGATTCCGGCCCAAGAAGCTGCGGTTCAAGCTCTTCAACATCCAGGTCAAGGAGGTCACGACGAATGA
CGGCGTTACGACCATCGCTAATAACCTTACCAGCACGATTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTAACGCTCAACAATGGCAGCCAGGCAGTGGGACGTTCCTCCTTCTACTGCCTGGAGTA
CTTCCCCTCTCAGATGCTGAGAACGGGCAACAACTTTGAGTTCAGCTACACCTTCGAGGACGTTCCTTTC
CACAGCAGCTACGCGCACAGCCAGAGCCTGGACCGGCTGATGAATCCTCTCATCGACCAATACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATTAAAGCCACTAACCCCGTGGCCACCGAAAGATTTGGGACTGTGGCAGTCAATCTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCTATTTGGGCCAAAATTCCTCACACAGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6WW

MH78 AMINO ACID SEQUENCE (SEQ ID NO:88)
DGYLPDWLEDNLSEGIREWWALKPGAPKPKANQQKQDDGRGLVLPGYKYLGPFNGLDKGEPVNAADAAAL
EHDKAYDQQLKAGDNPYLRYNHADAEFQERLQEDTSFGGNLGRAVFQAKKRVLEPFGLVEEGAKTAPGKK
RPVEQSPQEPDSSSGIGKTGQQPARKRLNFGQTGDSESVPDQPLGEPPATPAAVGPNTMAAGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKKLRFKLFNIQVKEVTTNDGVTTIANNLTSTIQVFSDSEYQLPY
VLGSAHQGCLPPFPADVFMIPQYGYLTLNNGSQAVGRSSFYCLEYFPSQMLRTGNNFEFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6XX

MH82 CODING SEQUENCE (SEQ ID NO:89)
GCTGCCGATGGTTATCTTCCAGATTGGCTCGAGGACAACCTCTCTGAGGGCATTCGCGAGTGGTGGGACT
TGAAACCTGGAGCCCCTCAACCCAAGGCAAATCAACAACATCAAGACAACGCTCGAGGTCTGGTGCTTCC
GGGTTACAAATACCTTGGACCCGGCAACGGACTCGACAAGGGGGAGCCCGTCAACGCGGCGGACGCAGCG
GCCCTCGAGCACGACAAAGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAAC
AGCCCGCCAGAAAAGACTCAATTTCGGTCAGACTGGCGACTCAGAGTCAGTCCCCGACCCTCAACCTCT
CGGAGAACCTCCAGCAACCCCCGCTGCTGTGGGACCTAATACAATGGCTTCAGGCGGTGGCGCACCAATG
GCAGACAATAACGAAGGCGCCGACGGAGTGGGTAATGCCTCAGGAAATTGGCATTGCGATTCCACATGGA
TGGGCGACAGAGTCATCACCACCAGCACCCGCACCTGGGCCTTGCCCACCTACAATAACCACCTCTACAA
GCAAATCTCCAGTGCTTCAACGGGGCCAGCAACGACAACCACTACTTCGGCTACAGCACCCCTGGGGG
TATTTTGATTTCAACAGATTCCACTGCCATTTCTCACCACGTGACTGGCAGCGACTCATCAACAACAACT
GGGGATTCCGGCCCAAGAGACTCAACTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAGGCAGTGGGACGGTCATCCTTTTACTGCCTGGAATA
TTTCCCATCGCAGATGCTGAGAACGGGCAATAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCCGTGGCCACCGAAAGATTTGGGACCGTGGCAGTCAATTTCC
AGAGCAGCAGCACAGACCCTGCGACCGGAGATGTGCATGCTATGGGAGCCTTACCTGGAATGGTGTGGCA
AGACAGAGACGTGTACCTGCAGGGTCCTATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTCACCCGTCCCCTGTAA

*FIG. 6YY*

MH82 AMINO ACID SEQUENCE (SEQ ID NO:90)
DGYLPDWLEDNLSEGIREWWDLKPGAPQPKANQQHQDNARGLVLPGYKYLGPGNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPARKRLNFGQTGDSESVPDQPLGEPPATPAAVGPNTMASGGGAPMAD
NNEGADGVGNASGNWHCDSTWMGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6ZZ*

MH90 CODING SEQUENCE (SEQ ID NO:91)
GCTGCCGATGGTTATCTTCCAGATTGGCTCGAGGACAACCTCTCTGAGGGCATTCGCGAGTGGTGGGCGC
TGCAACCTGGAGCCCCTAAACCCAAGGCAAATCAACAACATCAAGACAACGCTCGAGGTCTTGTGCTTCC
GGGTTACAAATACCTTGGACCCGGCAACGGACTCGACAAGGGGGAGCCGGTCAACGCAGCAGACGCGGCG
GCCCTCGAGCACGACAAGGCCTACGACCAGCAGCTCAAGGCCGGAGACAACCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGGTTCTCGAACCTTTTGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGAAAGGCCAAC
AGCCCGCCAGAAAAGACTCAATTTTGGTCAGACTGGCGACTCAGAGTCAGTTCCAGACCCTCAACCTCT
CGGAGAACCTCCAGCAGCGCCCTCTGGTGTGGGACCTAATACAATGGCTTCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACATGGGCCTTGCCCACCTACAATAACCACCTCTACAA
GCAAATCTCCAGTGCTTCAACGGGGGCCAGCAACGACAACCACTACTTCGGCTACAGCACCCCTGGGGG
TATTTTGACTTTAACAGATTCCACTGCCACTTTTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGTTG
CCGTACGTCCTCGGCTCTGCGCACCAGGGCTGCCTGCCTCCGTTCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAATACCTGTATT
ACCTGAGCAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCCGTGGCCACCGAAAGATTTGGGACCGTGGCAGTCAATTTCC
AGAGCAGCAGCACAGACCCTGCGACCGGAGATGTGCATGTTATGGGAGCCTTACCTGGAATGGTGTGGCA
AGATAGAGACGTGTACCTGCAGGGTCCCATTTGGGCCAAAATTCCTCACACAGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAATACTCCACAGGACA
AGTGAGTGTGGAAATTGAATGGGAGCTGCAGAAAGAAAACAGCAAACGCTGGAATCCCGAAGTGCAGTAC
ACATCCAATTATGCAAAATCTGCCAACGTTGATTTCACTGTGGACAACAATGGACTTTATACTGAGCCTC
GCCCCATTGGCACCCGTTACCTCACCCGTCCCCTGTAA

FIG. 6AAA

MH90 AMINO ACID SEQUENCE (SEQ ID NO:92)
DGYLPDWLEDNLSEGIREWWALQPGAPKPKANQQHQDNARGLVLPGYKYLGPGNGLDKGEPVNAADAAAL
EHDKAYDQQLKAGDNPYLRYNHADAEFQERLQEDTSFGGNLGRAVFQAKKRVLEPFGLVEEGAKTAPGKK
RPVEQSPQEPDSSSGIGKKGQQPARKRLNFGQTGDSESVPDPQPLGEPPAAPSGVGPNTMASGGGAPMAD
NNEGADVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLSRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHVMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6BBB

MH94 CODING SEQUENCE (SEQ ID NO:93)
GCTGCCGATGGTTATCTTCCAGATTGGCTCGAGGACAACCTCTCTGAGGGCATTCGCGAGTGGTGGGACT
TGAAACCTGGAGCCCCTCAACCCAAGGCAAATCAACAACATCAAGACAACGCTCGGGGTCTTGTGCTTCC
GGGTTACAAATACCTCGGACCCGGTAACGGACTCGACAAGGGGGAACCCGTCAACGCAGCGGACGCGGCA
GCCCTCGAGCACGACAAGGCCTACGACCAACAGCTGCAGGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAAGGCGCCGACGGAGTGGGTAATGCCTCAGGAAATTGGCATTGCGATTCCACATGGA
TGGGCGACAGAGTCATCACCACCAGCACCCGAACCTGGGCCTTGCCCACCTATAACAACCACCTCTACAA
GCAAATCTCCAGTGCTTCAACGGGGGCCAGCAACGACAACCACTACTTTGGCTACAGCACCCCCTGGGGG
TATTTTGATTTCAACAGATTCCACTGCCATTTCTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAGGCAGTGGGACGTTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGTCTGGACCGTCTCATGAATCCTCTCATCGACCAATACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCCATTTGGGCCAAAATTCCTCACACAGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAATACTCCACAGGACA
AGTGAGTGTGGAAATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

FIG. 6CCC

MH94 AMINO ACID SEQUENCE (SEQ ID NO:94)
DGYLPDWLEDNLSEGIREWWDLKPGAPQPKANQQHQDNARGLVLPGYKYLGPGNGLDKGEPVNAADAAAL
EHDKAYDQQLQAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPATPAAVGPTTMASGGGAPMAD
NNEGADGVGNASGNWHCDSTWMGDRVITTSTRTWALPTYNNHLYKQISSASTGASNDNHYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGCYRQQRVSKTK
TDNNNSNFTWTGASKYNLNGRESIINPGTAMASHKDDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6DDD

MH95 CODING SEQUENCE (SEQ ID NO:95)

GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAAGCAGGACAACGGCCGGGGTCTGGTGCTTCC
TGGCTACAAGTACCTCGGACCCGGCAACGGACTCGACAAGGGGGAGCCCGTCAACGCGGCGGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAGC
AGCCCGCTAAAAAGAGACTCAATTTTGGTCAGACTGGCGACTCAGAGTCAGTCCCAGACCCTCAACCTCT
CGGAGAACCTCCAGCAGCGCCCTCTGGTGTGGGACCTAATACAATGGCTTCAGGTGGTGGCGCACCAATG
GCAGACAATAACGAAGGTGCCGACGGAGTGGGTAATTCCTCAGGAAATTGGCATTGCGATTCCACATGGC
TGGGCGACAGAGTCATCACCACCAGCACCCGAACATGGGCCTTGCCCACCTACAATAACCACCTCTACAA
GCAAATCTCCAGTGCTTCAACGGGGCCAGCAACGACAACCACTACTTCGGCTACAGCACCCCTGGGGG
TATTTTGATTTCAACAGATTCCACTGCCATTTCTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTG
CCGTACGTCCTCGGCTCTGCGCACCAGGGCTGCCTCCCTCCGTTCCCGGCGGACGTGTTCATGATTCCGC
AGTACGGCTACCTAACGCTAACAATGGCAGCCAGGCAGTGGGACGGTCATCCTTTTACTGCCTGGAATA
TTTCCCTTCTCAGATGCTGAGAACGGGCAACAACTTTGAGTTCAGCTACACTTTTGAGGACGTTCCTTTC
CACAGCAGCTACGCTCACAGCCAGAGTCTGGACCGTCTCATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACGAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATCTCC
AGAGCAGCAGCACAGACCCTGCGACCGGAGATGTGCATGCTATGGGAGCATTACCTGGCATGGTGTGGCA
AGATAGAGACGTATACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAATACTCCACAGGACA
AGTGAGCGTGGAAATTGAATGGGAGCTGCAGAAAGAAAACAGCAAACGCTGGAATCCCGAAGTGCAGTAT
ACATCTAACTATGCAAAATCTGCCAACGTTGATTTACTGTGGACAACAATGGACTTTATACTGAGCCTC
GCCCCATTGGCACCCGTTACCTTACCCGTCCCCTGTAA

FIG. 6EEE

MH95 AMINO ACID SEQUENCE (SEQ ID NO:96)

DGYLPDWLEDNLSEGIREWWDLKPGAPKPKANQQKQDNGRGLVLPGYKYLGPGNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSGVGPNTMASGGGAPMAD
NNEGADGVGNSSGNWHCDSTWLGDRVITTSTRTWALPTYNNHLYKQISSASTGASNDNHYFGYSTPWGYF
DFNRFHCHFSPRDWQRLINNNWGFRPKKLRFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFEFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDEDKFFPMSGVMIFGKESAGASNTALDNVMITDE
EEIKATNPVATERFGTVAVNLQSSSTDPATGDVHAMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

FIG. 6FFF

MH107 CODING SEQUENCE (SEQ ID NO:97)
GCTGCCGATGGTTATCTTCCAGATTGGCTCGAGGACAACCTCTCTGAGGGCATTCGCGAGTGGTGGGACT
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAGCCCGTCAACGCGGCGGATGCAGCG
GCCCTCGAGCACGACAAGGCCTACGACCAGCAGCTGCAGGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGATCCTTGAGCCTCTTGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGACCCACAACCTCT
CGGAGAACCTCCAGCAACCCCCGCTGCTGTGGGACCTAATACAATGGCTGCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACCTGGGCCCTGCCCACCTACAACAACCACCTCTACAA
GCAAATCTCCAGTGCTTCAACGGGGGCCAGCAACGACAACCACTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACAACCATCGCTAATAACCTTACCAGCACGATTCAGGTATTCTCGGACTCGGAATACCAGCTT
CCGTACGTCCTCGGCTCTGCGCACCAGGGCTGCCTGCCTCCGTTCCCGGCGGACGTGTTCATGATTCCGC
AGTACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAATTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCCGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCCATTTGGGCCAAAATTCCTCACACAGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTCACCCGTCCCCTGTAA

*FIG. 6GGG*

MH107 AMINO ACID SEQUENCE (SEQ ID NO:98)
DGYLPDWLEDNLSEGIREWWDLKPGAPKPKANQQKQDDGRGLVLPGYKYLGPFNGLDKGEPVNAADAAAL
EHDKAYDQQLQAGDNPYLRYNHADAEFQERLQEDTSFGGNLGRAVFQAKKRILEPLGLVEEGAKTAPGKK
RPVEQSPQEPDSSSGIGKTGQQPAKKRLNFGQTGDSESVPDPQPLGEPPATPAAVGPNTMAAGGGAPMAD
NNEGADGVGNASGNWHCDSTWLGDRVITTSTRTWALPTYNNHLYKQISSASTGASNDNHYFGYSTPWGYF
DFNRFHCHFSPRDWQRLINNNWGFRPKRLNFKLFNIQVKEVTTNDGVTTIANNLTSTIQVFSDSEYQLPY
VLGSAHQGCLPPFPADVFMIPQYGYLTLNNGSQAVGRSSFYCLEYFPSQMLRTGNNFTFSYTFEEVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6HHH*

MH113 CODING SEQUENCE (SEQ ID NO:99)

GCTGCCGATGGTTATCTTCCAGATTGGCTCGAGGACAACCTCTCTGAGGGCATTCGCGAGTGGTGGGACT
TGAAACCTGGAGCCCCTCAACCCAAGGCAAATCAACAACATCAAGACAACGCTCGAGGTCTGGTGCTTCC
GGGTTACAAATACCTTGGACCCGGCAACGGACTCGACAAGGGGGAACCCGTCAACGCAGCGGACGCGGCA
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCAGACCCTCAACCTCT
CGGAGAACCTCCAGCAGCGCCCTCTGGTGTGGGACCTAATACAATGGCTGCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATTACCACCAGCACCAGAACCTGGTCTTGCCCACCTACAACAACCACCTCTACAA
GCAAATCTCCAGTGCTTCAACGGGGCCAGCAACGACAACCACTACTTCGGCTACAGCACCCCTGGGGG
TATTTTGATTTCAACAGATTCCACTGCCATTTCTCACCACGTGACTGGCAGCGACTCATCAACAACAACT
GGGGATTCCGGCCCAAGAGACTCAACTTCAAACTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGTTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGAATGGTGTGGCA
AGACAGAGACGTATACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCCAATCCTCCGGCAGAGTTTTCGGCTACAAAGTTTGCTTCATTCATCACCCAGTATTCCACAGGACA
AGTGAGTGTGGAAATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
CAACCATTGGCACCCGTTACCTCACCCGTCCCCTGTAA

*FIG. 6III*

MH113 AMINO ACID SEQUENCE (SEQ ID NO:100)

DGYLPDWLEDNLSEGIREWWDLKPGAPQPKANQQHQDNARGLVLPGYKYLGPGNGLDKGEPVNAADAAAL
EHDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPAKKRLNFGQTGDSESVPDPQPLGEPPAAPSGVGPNTMAAGGAPMAD
NNEGADGVGNASGNWHCDSTWLGDRVITTSTRTWVLPTYNNHLYKQISSASTGASNDNHYFGYSTPWGYF
DFNRFHCHFSPRDWQRLINNNWGFRPKRLNFKLFNIQVKEVTTNDGVTTIANNLTSTVQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPVGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNLQSSSTDPATGDVHVMGALPGMVWQDRDVYLQGPIWAKIPHTDGHFHPSP
LMGGFGLKHPPPQILIKNTPVPANPPAEFSATKFASFITQYSTGQVSVEIEWELQKENSKRWNPEVQYTS
NYAKSANVDFTVDNNGLYTEPPTIGTRYLTRPL

*FIG. 6JJJ*

MM4 CODING SEQUENCE (SEQ ID NO:101)
GCTGCCGATGGTTATCTTCCAGATTGGCTCGAGGACAACCTCTCTGAGGGCATTCGCGAGTGGTGGGCGC
TGAAACCTGGAGCCCCGAAACCCAAAGCGAACCAACAACACCAGGACAACCGTCGGGGTCTTGTGCTTCC
GGGTTACAAATACCTCGGACCCGGCAACGGACTCGACAAGGGGGAACCCGTCAACGCAGCGGACGCGGCA
GCCCTCGAGTACGACAAGGCCTACGACCAGCAGCTCAAAGCGGGTGACAACCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAGC
AGCCCGCCAGAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACCTGGGTCTTGCCCACCTATAACAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCACTTCTCACCACGTGACTGGCAGCGACTCATCAACAACAACT
GGGGATTCCGGCCCAAGAAGCTGCGGTTCAAGCTCTTCAACATCCAGGTCAAGGAGGTCACGACGAATGA
CGGCGTTACGACCATCGCTAATAACCTTACCAGCACGATTCAGGTATTCTCGGACTCGGAGTACCAGCTT
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCACACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACATGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGACAGAGACGTGTACCTGCAGGGTCCATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

*FIG. 6KKK*

MM4 AMINO ACID SEQUENCE (SEQ ID NO:102)
DGYLPDWLEDNLSEGIREWWALKPGAPKPKANQQHQDNRRGLVLPGYKYLGPGNGLDKGEPVNAADAAAL
EYDKAYDQQLKAGDNPYLRYNHADAEFQERLQEDTSFGGNLGRAVFQAKKRVLEPLGLVEEGAKTAPGKK
RPVEQSPQEPDSSSGIGKTGQQPARKRLNFGQTGDSESVPDPQPLGEPPATPAAVGPTTMASGGGAPMAD
NNEGADGVGNASGNWHCDSTWLGDRVITTSTRTWVLPTYNNHLYKQISSETAGSTNDNTYFGYSTPWGYF
DFNRFHCHFSPRDWQRLINNNWGFRPKKLRFKLFNIQVKEVTTNDGVTTIANNLTSTIQVFSDSEYQLPY
VLGSAHQGCLPPFPADVFMIPQYGYLTLNNGSQAVGRSSFYCLEYFPSQMLRTGNNFTFSYTFEDVPFHS
SYAHSQSLDRLMNPLIDQYLYYLNRTQNQSGSAQNKDLLFSRGSPAGMSVQPKNWLPGPCYRQQRVSKTK
TDNNNSNFTWTGASKYNLNGRESIINPGTAMASHKDDKDKFFPMSGVMIFGKESAGASNTALDNVMITDE
EEIKATNPVATERFGTVAVNFQSSSTDPATGDVHAMGALPGMVWQDRDVYLQGPIWAKIPHTDGHFHPSP
LMGGFGLKNPPPQILIKNTPVPANPPAEFSATKFASFITQYSTGQVSVEIEWELQKENSKRWNPEVQYTS
NYAKSANVDFTVDNNGLYTEPRPIGTRYLTRPL

*FIG. 6LLL*

MM7 CODING SEQUENCE (SEQ ID NO:103)
GCTGCCGATGGTTATCTTCCAGATTGGCTCGAGGACACTCTCTCTGAAGGAATAAGACAGTGGTGGAAGC
TCAAACCTGGCCCACCACCACCAAAGCCCGCAGAGCGGCATAAGGACGACAGCAGGGGTCTTGTGCTTCC
TGGGTACAAGTACCTCGGACCCTTCAACGGACTCGACAAGGGAGAGCCGGTCAACGAGGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTCGGTCAGACTGGCGACTCAGAGTCAGTCCCCGACCCTCAACCTCT
CGGAGAACCTCCAGCAGCGCCCTCTGGTGTGGGACCTAATACAATGGCTGCAGGCGGTGGCGCACCAATG
GCAGACAATAACGAAGGCGCCGACGGAGTGGGTAGTTCCTCGGGAAATTGGCATTGCGATTCCACATGGC
TGGGGGACAGAGTCATCACCACCAGCACCAGAACCTGGGTCTTGCCCACCTACAACAACCACCTCTACAA
GCAAATCTCCAGTGCTTCAACGGGGCCAGCAACGACAACCACTACTTCGGCTACAGCACCCCCTGGGGG
TATTTTGATTTCAACAGATTCCACTGCCACTTCTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
CGGCGTTACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCGGCGGACGTGTTCATGATTCCGC
AATACGGCTACCTGACGCTCAACAATGGCAGCCAAGCCGTGGACGTTCATCCTTCTACTGCCTGGAATA
TTTCCCATCGCAGATGCTGAGAACGGGCAATAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCTGTGGCCACCGAAAGATTTGGGACCGTGGCAGTCAATTTCC
AGAGCAGCAGCACAGACCCTGCGACCGGAGATGTGCATGTTATGGGAGCCTTACCTGGAATGGTGTGGCA
AGACAGAGACGTGTACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGTGTGGAAATTGAATGGGAGCTGCAGAAAGAAAACAGCAAGCGCTGGAATCCCGAAGTGCAGTAC
ACATCCAATTATGCAAAATCTGCCAACGTTGATTTCACTGTGGACAACAATGGACTTTATACTGAGCCTC
GCCCCATTGGCACCCGTTACCTTACCCGTCCCCTGTAA

FIG. 6MMM

MM7 AMINO ACID SEQUENCE (SEQ ID NO:104)
DGYLPDWLEDTLSEGIRQWWKLKPGPPPPKPAERHKDDSRGLVLPGYKYLGPFNGLD
KGEPVNEADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPAAPSGVGPNTMAAGGGAPMADNNEGADGVGSSSGNWHCDSTWLGDRVI
TTSTRTWVLPTYNNHLYKQISSASTGASNDNHYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNFQSSSTDPATGDVHVMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6NNN

MM19 CODING SEQUENCE (SEQ ID NO:105)
GCTGCCGATGGTTATCTTCCAGATTGGCTCGAGGACAACCTCTCTGAGGGCATTCGCGAGTGGTGGGCGC
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAGCCCGTCAACGCGGCGGACGCAGCG
GCCCTCGAGCACGACAAGGCCTACGACCAGCAGCTCCAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAAAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAGGGTGCCGACGAGTGGGTAATGCCTCAGGAAATTGGCATTGCGATTCCACATGGC
TGGGCGACAGAGTCATCACCACCAGCACCCGAACCTGGGCCTTGCCCACCTATAACAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCACTTTTCACCACGTGACTGGCAGCGACTCATCAACAACAACT
GGGGATTCCGGCCCAAGAGACTCAACTTCAAGCTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAATACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACCGTGGCAGTCAATTTCC
AGAGCAGCAGCACAGACCCTGCGACCGGAGATGTGCATGCTATGGGAGCCTTACCTGGCATGGTGTGGCA
AGATAGAGACGTGTACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAATACTCCACAGGACA
AGTGAGTGTGGAAATTGAATGGGAGCTGCAGAAAGAAAACAGCAAGCGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTCACCCGTCCCCTGTAA

FIG. 6OOO

MM19 AMINO ACID SEQUENCE (SEQ ID NO:106)
DGYLPDWLEDNLSEGIREWWALKPGAPKPKANQQKQDDGRGLVLPGYKYLGPFNGLD
KGEPVNAADAAALEHDKAYDQQLQAGDNPYLRYNHADAEFQERLQEDTSFGGNLGRAVFQ
AKKRVLEPLGLVEEGAKTAPGKKRPVEQSPQEPDSSSGIGKTGQQPAKKRLNFGQTGDSE
SVPDPQPLGEPPATPAAVGPTTMASGGGAPMADNNEGADGVGNASGNWHCDSTWLGDRVI
TTSTRTWALPTYNNHLYKQISSETAGSTNDNTYFGYSTPWGYFDFNRFHCHFSPRDWQRL
INNNWGFRPKRLNFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNFQSSSTDPATGDVHAMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6PPP

MM35 CODING SEQUENCE (SEQ ID NO:107)
GCTGCCGATGGTTATCTTCCAGATTGGCTCGAGGACAACCTCTCTGAGGGCATTCGCGAGTGGTGGGACT
TGAAACCTGGAGCCCCGAAGCCCAAAGCCAACCAACAACACCAGGACAACCGTCGGGGTCTTGTGCTTCC
GGGTTACAAGTACCTCGGACCCTTCAACGGACTCGACAAGGGGGAGCCGGTCAACGCAGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGAAAGGCCAAC
AGCCCGCCAGAAAAAGACTCAATTTTGGTCAGACTGGCGACTCAGAGTCAGTCCCAGACCCTCAACCTCT
CGGAGAACCACCAGCAGCCCCCGCTGCTGTGGGACCTACTACAATGGCTTCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGCACCTGGGCCTTGCCCACCTACAATAACCACCTCTACAA
GCAAATCTCCAGTGAAACTGCAGGTAGTACCAACGACAACACCTACTTCGGCTACAGCACCCCTGGGGG
TATTTTGACTTTAACAGATTCCACTGCCACTTCTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGGTCATCCTTTTACTGCCTGGAATA
TTTCCCATCGCAGATGCTGAGAACGGGCAACAACTTTGAGTTCAGCTACAGCTTCGAGTACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAATTTTACCTGGACTGGTGCTTCAAAATATAACCTCAATGGGCGTG
AATCCATCATCAACCCTGGCACTGCTATGGCCTCACACAAAGACGACGAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCTGTGGCCACCGAAAGATTTGGGACCGTGGCAGTCAATCTCC
AGAGCAGCAGCACAGACCCTGCGACCGGAGATGTGCATGCTATGGGAGCCTTACCTGGAATGGTGTGGCA
AGACAGAGACGTGTACCTGCAGGGTCCTATTTGGGCCAAAATTCCTCACACAGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTCACCCGTCCCCTGTAA

FIG. 6QQQ

MM35 AMINO ACID SEQUENCE (SEQ ID NO:108)
DGYLPDWLEDNLSEGIREWWDLKPGAPKPKANQQHQDNRRGLVLPGYKYLGPFNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKKGQQPARKRLNFGQTGDSE
SVPDPQPLGEPPAAPAAVGPTTMASGGGAPMADNNEGADGVGNASGNWHCDSTWLGDRVI
TTSTRTWALPTYNNHLYKQISSETAGSTNDNTYFGYSTPWGYFDFNRFHCHFSPRDWQRL
INNNWGFRPKRLNFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFEFSYSFEYVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDEDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6RRR

MM44 CODING SEQUENCE (SEQ ID NO:109)
GCTGCCGATGGTTATCTTCCAGATTGGCTCGAGGACAACCTCTCTGAGGGCGTTCGAGAGTGGTGGGCGC
TGCAACCTGGAGCCCCTAAACCCAAGGCAAATCAACAACATCAGGACAACGCTCGGGGTCTTGTGCTTCC
GGGTTACAAATACCTCGGACCCGGTAACGGACTCGACAAAGGAGAGCCCGTCAACGCGGCGGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTTGGTCAGACTGGCGACTCAGAGTCAGTCCCCGATCCACAACCTCT
CGGAGAACCTCCAGCAGCGCCCTCTGGTGTGGGACCTAATACAATGGCTTCAGGTGGTGGCGCACCAATG
GCAGACAATAACGAGGGTGCCGATGGAGTGGGTAATTCCTCAGGAAATTGGCATTGCGATTCCACATGGC
TGGGCGACAGAGTCATCACCACCAGCACCAGAACCTGGGTCTTGCCCACCTACAACAACCACCTCTACAA
GCAAATCTCCAGTGCTTCAACGGGGGCAGCAACGACAACCACTACTTCGGCTACAGCACCCCCTGGGGG
TATTTTGATTTCAACAGATTCCACTGCCACTTCTCACCACGTGACTGGCAGCGACTCATCAACAACAATT
GGGGATTCCGGCCCAAGAAGCTGCGGTTCAAGCTCTTCAACATCCAAGTCAAGGAGGTCACGACGAATGA
CGGCGTTACGACCATCGCTAATAACCTTACCAGCACGGTTCAAGTCTTCTCGGACTCGGAGTACCAGCTG
CCGTACGTCCTCGGCTCTGCGCACCAGGGCTGCCTCCCTCCGTTCCCGGCGGACGTGTTCATGATTCCGC
AATACGGCTACCTAACGCTCAACAATGGCAGCCAGGCAGTGGGACGTTCATCCTTTTACTGCCTGGAATA
TTTCCCATCGCAGATGCTGAGAACGGGCAACAACTTTACCTTCAGCTACACCTTCGAGTACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCCGTGGCCACCGAAAGATTTGGGACTGTGGCAGTCAATCTCC
AGAGCAGCAGCACAGACCCTGCGACCGGAGATGTGCATGCTATGGGAGCATTACCTGGCATGGTGTGGCA
AGATAGAGACGTATACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTCACTGTGGACAACAATGGACTTTATACTGAGCCTC
GCCCCATTGGCACCCGTTACCTCACCCGTCCCCTGTAA

FIG. 6SSS

MM44 AMINO ACID SEQUENCE (SEQ ID NO:110)
DGYLPDWLEDNLSEGVREWWALQPGAPKPKANQQHQDNARGLVLPGYKYLGPGNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPAAPSGVGPNTMASGGGAPMADNNEGADGVGNSSGNWHCDSTWLGDRVI
TTSTRTWVLPTYNNHLYKQISSASTGASNDNHYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEYVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6TTT

MM55 CODING SEQUENCE (SEQ ID NO:111)

```
GCTGCCGATGGTTATCTTCCAGATTGGCTCGAGGACAACCTCTCTGAGGGCATTCGCGAGTGGTGGGCGC
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAGCCCGTCAACGCGGCGGATGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGTGCTAAGACGGCTCCTGGA
AAGAAACGTCCGGTAGAGCAGTCGCCACAAGAGCCAGACTCCTCCTCGGGCATTGGCAAGACAGGCCAAC
AGCCCGCCAGAAAAAGACTCAATTTTGGTCAGACTGGCGACTCAGAGTCAGTCCCAGACCCTCAACCTCT
CGGAGAACCTCCAGCAGCGCCCTCTGGTGTGGGACCTAATACAATGGCTTCAGGTGGTGGCGCACCAATG
GCAGACAATAACGAAGGTGCCGACGGAGTGGGTAATGCCTCAGGAAATTGGCATTGCGATTCCACATGGC
TGGGCGACAGAGTCATCACCACCAGCACCCGCACCTGGGCCTTGCCCACCTACAACAACCACCTCTACAA
GCAAATCTCCAGTGCTTCAACGGGGGCCAGCAACGACAACCACTACTTTGGCTACAGCACCCCCTGGGGG
TATTTTGATTTCAACAGATTCCACTGCCATTTCTCACCACGTGACTGGCAGCGACTCATCAACAACAACT
GGGGATTCCGGCCCAAGAAGCTGCGGTTCAAGCTCTTCAACATCCAGGTCAAGGAGGTCACGACGAATGA
CGGCGTTACGACCATCGCTAATAACCTTACCAGCACGGTTCAAGTCTTCTCGGACTCGGAGTACCAGCTC
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAGGCAGTGGGACGTTCATCCTTTTACTGCCTGGAATA
TTTCCCATCGCAGATGCTGAGAACGGGCAACAACTTTGAGTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAATTTTACCTGGACTGGTGCTTCAAAATATAACCTTAATGGGCGTG
AATCTATAATCAACCCTGGCACTGCTATGGCCTCACACAAAGACGACGAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCCATTTGGGCCAAAATTCCTCACACAGATGGACACTTTCACCCG
TCTCCTCTTATGGGCGGCTTTGGACTTAAGCACCCGCCTCCTCAGATCCTCATCAAAAACACGCCTGTTC
CTGCGAATCCTCCGGCAGAGTTTTTGGCTACAAAGTTTGCTTCATTCATCACCCAGTATTCCACAGGACA
AGTGAGCGTGGAGATTGAATGGGAGCTGCAGAAGGAAAACAGCAAACGCTGGAATCCCGAAGTGCAGTAC
ACATCCAACTTTGAAAAGCAGACTGGTGTGGACTTTGCTGTTAATACAGAAGGCGTGTACTCTGAACCCC
GCCCCATTGGCACCCGTTACCTCACCCGTAATCTGTAA
```

FIG. 6UUU

MM55 AMINO ACID SEQUENCE (SEQ ID NO:112)

```
DGYLPDWLEDNLSEGIREWWALKPGAPKPKANQQKQDDGRGLVLPGYKYLGPFNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPAAPSGVGPNTMASGGGAPMADNNEGADGVGNASGNWHCDSTWLGDRVI
TTSTRTWALPTYNNHLYKQISSASTGASNDNHYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFEFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDEDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKHPPPQILIKNTPVPANPPA
EFLATKFASFITQYSTGQVSVEIEWELQKENSKRWNPEVQYTSNFEKQTGVDFAVNTEGV
YSEPRPIGTRYLTRNL
```

FIG. 6VVV

MM65 CODING SEQUENCE (SEQ ID NO:113)
GCTGCCGATGGTTATCTTCCAGATTGGCTCGAGGACAACCTCTCTGAGGGCATTCGCGAGTGGTGGGACC
TGAAACCTGGAGCCCCGAAACCCAAAGCCAACCAGCAAAAGCAGGACAACGGCCGGGGTCTGGTGCTTCC
TGGCTACAAGTACCTCGGACCCTTCAACGGACTCGACAAGGGGGAACCCGTCAACGCAGCGGACGCGGCA
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGCAGCTAAAACGGCTCCTGGA
AAGAAGAGGCCTGTAGATCAGTCTCCTCAGGAACCGGACTCATCATCTGGTGTTGGCAAATCGGGCAAAC
AGCCTGCCAGAAAAAGACTAAATTTCGGTCAGACTGGCGACTCAGAGTCAGTCCCCGACCCTCAACCTCT
CGGAGAACCTCCAGCAACCCCCGCTGCTGTGGGACCTAATACAATGGCTGCAGGCGGTGGCGCACCAATG
GCAGACAATAACGAAGGTGCCGACGGAGTGGGTAATGCCTCAGGAAATTGGCATTGCGATTCCACATGGC
TGGGCGACAGAGTCATTACCACCAGCACCCGAACCTGGGCCCTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGATTTCAACAGATTCCACTGCCATTTCTCACCACGTGACTGGCAGCGACTCATCAACAACAATT
GGGGATTCCGGCCAAGAAGCTGCGGTTCAAGCTCTTCAACATCCAAGTCAAGGAGGTCACGACGAATGA
CGGCGTTACGACCATCGCTAATAACCTTACCAGCACGGTTCAAGTCTTCTCGGACTCGGAGTACCAGTTG
CCGTACGTCCTCGGCTCTGCGCACCAGGGCTGCCTGCCTCCGTTCCCGGCGGACGTGTTCATGATTCCGC
AGTACGGCTACCTAACGCTCAACAATGGCAGCCAAGCCGTGGGACGTTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATTAAAGCCACTAACCCTGTGGCCACCGAAAGATTTGGGACTGTGGCAGTCAATTTCC
AGAGCAGCAGCACAGACCCTGCGACCGGAGATGTGCATGCTATGGGAGCATTACCTGGCATGGTGTGGCA
AGATAGAGACGTATACCTGCAGGGTCCTATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

FIG. 6WWW

MM65 AMINO ACID SEQUENCE (SEQ ID NO:114)
DGYLPDWLEDNLSEGIREWWDLKPGAPKPKANQQKQDNGRGLVLPGYKYLGPFNGLD
KGEPVNAADAAALEHDKAYDQQLKAGDNPYLRYNHADAEFQERLQEDTSFGGNLGRAVFQ
AKKRVLEPLGLVEEAAKTAPGKKRPVDQSPQEPDSSSGVGKSGKQPARKRLNFGQTGDSE
SVPDPQPLGEPPATPAAVGPNTMAAGGAPMADNNEGADGVGNASGNWHCDSTWLGDRVI
TTSTRTWALPTYNNHLYKQISSETAGSTNDNTYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLP
GPCYRQQRVSKTKTDNNSNFTWTGASKYNLNGRESIINPGTAMASHKDDKDKFFPMSGV
MIFGKESAGASNTALDNVMITDEEEIKATNPVATERFGTVAVNFQSSSTDPATGDVHAMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6XXX

MM68 CODING SEQUENCE (SEQ ID NO:115)
GCTGCCGATGGTTATCTTCCAGATTGGCTCGAGGACAACCTCTCTGAGGGCATTCGCGAGTGGTGGGACT
TGAAACCTGGAGCCCCTAAACCCAAGGCAAATCAACAACATCAGGACAACGCTCGGGGTCTTGTGCTTCC
TGGCTACAAGTACCTCGGACCCTTCAACGGACTCGACAAGGGGGAGCCCGTCAACGCGGCGGATGCAGCG
GCCCTCGAGCACGACAAGGCCTACGACCAGCAGCTGCAGGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAGGGTGCCGATGGAGTGGGTAATTCCTCAGGAAATTGGCATTGCGATTCCACATGGC
TGGGCGACAGAGTCATCACCACCAGCACCCGAACATGGGCCTTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCACTTTTCACCACGTGACTGGCAGCGACTCATCAACAACAATT
GGGGATTCCGGCCCAAGAGACTCAACTTCAAACTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGTTG
CCGTACGTCCTCGGCTCTGCGCACCAGGGCTGCCTGCCTCCGTTCCCGGCGGACGTGTTCATGATTCCGC
AGTACGGCTACCTAACGCTCAACAATGGCAGCCAGGCAGTGGGACGGTCATCCTTTTACTGCCTGGAGTA
CTTCCCCTCTCAGATGCTGAGAACGGGCAACAACTTTGAGTTCAGCTACACCTTCGAGGACGTTCCTTTC
CACAGCAGCTACGCACACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATCTCC
AGAGCAGCAGCACAGACCCTGCGACCGGAGATGTGCATGTTATGGGAGCCTTACCTGGCATGGTGTGGCA
AGATAGAGACGTGTACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCGGAGTTTTCAGCTACAAAGTTTGCTTCATTCATCACCCAATACTCCACAGGACA
AGTGAGCGTGGAGATTGAATGGGAGCTGCAGAAGAAAACAGCAAACGCTGGAATCCCGAAGTGCAGTAT
ACATCTAACTATGCAAAATCTGCCAACGTTGATTTCACTGTGGACAACAATGGACTTTATACTGAGCCTC
GCCCCATTGGCACCCGTTACCTTACCCGTCCCTGTAA

FIG. 6YYY

MM68 AMINO ACID SEQUENCE (SEQ ID NO:116)
DGYLPDWLEDNLSEGIREWWDLKPGAPKPKANQQHQDNARGLVLPGYKYLGPFNGLD
KGEPVNAADAAALEHDKAYDQQLQAGDNPYLRYNHADAEFQERLQEDTSFGGNLGRAVFQ
AKKRVLEPLGLVEEGAKTAPGKKRPVEQSPQEPDSSSGIGKTGQQPAKKRLNFGQTGDSE
SVPDPQPLGEPPATPAAVGPTTMASGGGAPMADNNEGADGVGNSSGNWHCDSTWLGDRVI
TTSTRTWALPTYNNHLYKQISSETAGSTNDNTYFGYSTPWGYFDFNRFHCHFSPRDWQRL
INNNWGFRPKRLNFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFEFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNLQSSSTDPATGDVHVMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6ZZZ

MM84 CODING SEQUENCE (SEQ ID NO:117)
GCTGCCGATGGTTATCTTCCAGATTGGCTCGAGGACAACCTCTCTGAGGGCATTCGCGAGTGGTGGGACT
TGAAACCTGGAGCCCCGAAACCCAAAGCCAACCAGCAAAAGCAGGACGACGGCCGGGGTCTGGTGCTTCC
TGGCTACAAGTACCTCGGACCCTTCAACGGACTCGACAAGGGGGAGCCCGTCAACGCAGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCACGGGCATCGGCAAGAAAGGCCAGC
AGCCCGCCAGAAAGAGACTCAATTTCGGTCAGACTGGCGACTCAGAGTCAGTCCCAGACCCTCAACCTCT
CGGAGAACCTCCAGCAACCCCCGCTGCTGTGGGACCTACTACAATGGCTTCAGGCGGTGGCGCACCAATG
GCAGACAATAACGAAGGTGCCGACGGAGTGGGTAATGCCTCAGGAAATTGGCATTGCGATTCCACATGGA
TGGGCGACAGAGTCATTACCACCAGCACCCGAACCTGGGCCTTGCCCACCTACAATAACCACCTCTACAA
GCAAATCTCCAGTGCTTCAACGGGGGCCAGCAACGACAACCACTACTTTGGCTACAGCACCCCCTGGGGG
TATTTTGATTTCAACAGATTCCACTGCCACTTCTCACCACGTGACTGGCAGCGACTCATCAACAACAACT
GGGGATTCCGGCCCAAGAGACTCAACTTCAAGCTCTTCAACATCCAGGTCAAAGAGGTCACGCAGAATGA
CGGTACGACGACGATTGCCAATAACCTTACCAGCACGGTTCAGGTGTTTACTGACTCGGAGTACCAGTTG
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACTGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCTATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTCACTGTGGACAACAATGGACTTTATACTGAGCCTC
GCCCCATTGGCACCCGTTACCTCACCCGTCCCCTGTAA

FIG. 6AAAA

MM84 AMINO ACID SEQUENCE (SEQ ID NO:118)
DGYLPDWLEDNLSEGIREWWDLKPGAPKPKANQQKQDDGRGLVLPGYKYLGPFNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSTGIGKKGQQPARKRLNFGQTGDSE
SVPDPQPLGEPPATPAAVGPTTMASGGGAPMADNNEGADVGNASGNWHCDSTWMGDRVI
TTSTRTWALPTYNNHLYKQISSASTGASNDNHYFGYSTPWGYFDFNRFHCHFSPRDWQRL
INNNWGFRPKRLNFKLFNIQVKEVTQNDGTTTIANNLTSTVQVFTDSEYQLPYVLGSAHQ
GCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNFQSSSTDPATGDVHAMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6BBBB

MM107 CODING SEQUENCE (SEQ ID NO:119)
GCTGCCGATGGTTATCTTCCAGATTGGCTCGAGGACAACCTCTCTGAGGGCATTCGCGAGTGGTGGGCGC
TGAAACCTGGAGCCCCGAAGCCCAAAGCCAACCAGCAAAAGCAGGACGACGGCCGGGGTCTGGTGCTTCC
TGGCTACAAGTACCTCGGACCCTTCAACGGACTCGACAAGGGGGAGCCCGTCAACGCGGCGGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAAC
AGCCCGCCAGAAAAAGACTAAATTTCGGTCAGACTGGCGACTCAGAGTCAGTCCCCGACCCACAACCTCT
CGGAGAACCTCCAGCAACCCCGCTGCTGTGGGACCTACTACAATGGCTTCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCAGAACCTGGGTCTTGCCCACCTACAACAACCACCTCTACAA
GCAAATCTCCAGTGAAACTGCAGGTAGTACCAACGACAACACCTACTTCGGCTACAGCACCCCTGGGGG
TATTTTGATTTCAACAGATTCCACTGCCATTTCTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTG
CCGTACGTCCTCGGCTCTGCGCACCAGGGCTGCCTGCCTCCGTTCCGGCGGACGTCTTCATGATTCCTC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAACAACTTTGAGTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCTGTGGCCACCGAAAGATTTGGGACCGTGGCAGTCAATCTCC
AGAGCAGCAGCACAGACCCTGCGACCGGAGATGTGCATGCTATGGGAGCCTTACCTGGAATGGTGTGGCA
AGATAGAGACGTGTACCTGCAGGGTCCCATTTGGGCCAAAATTCCTCACACGGATGGACACTTTCACCCG
TCTCCTCTTATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGTGTGGAAATTGAATGGGAGCTGCAGAAAGAAAACAGCAAGCGCTGGAATCCCGAAGTGCAGTAC
ACATCCAATTATGCAAAATCTGCCAACGTTGATTTCACTGTGGACAACAATGGACTTTATACTGAGCCTC
GCCCCATTGGCACCCGTTACCTTACCCGTCCCCTGTAA

FIG. 6CCCC

MM107 AMINO ACID SEQUENCE (SEQ ID NO:120)
DGYLPDWLEDNLSEGIREWWALKPGAPKPKANQQKQDDGRGLVLPGYKYLGPFNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPATPAAVGPTTMASGGGAPMADNNEGADGVGNASGNWHCDSTWLGDRVI
TTSTRTWVLPTYNNHLYKQISSETAGSTNDNTYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFEFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6DDDD

MM112 CODING SEQUENCE (SEQ ID NO:121)
GCTGCCGATGGTTATCTTCCAGATTGGCTCGAGGACAACCTCTCTGAGGGCATTCGTGAGTGGTGGGCTC
TGAAACCTGGAGTCCCTCAACCCAAAGCGAACCAACAACACCAGGACAACCGTCGGGGTCTGGTGCTTCC
TGGCTACAAGTACCTCGGACCCTTCAACGGACTCGACAAGGGGGAGCCCGTCAACGCGGCGGACGCGGCA
GCCCTCGAGCACGACAAGGCCTACGACCAGCAGCTGCAGGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGACCCACAACCTCT
CGGAGAACCTCCAGCAGCGCCCTCTGGTGTGGGACCTAATACAATGGCTGCAGGCAGTGGCGCACCAATG
GCAGACAATAACGAGGGTGCCGACGGAGTGGGTAATGCCTCAGGAAATTGGCATTGCGATTCCACATGGC
TGGGCGACAGAGTCATCACCACCAGCACCCGCACCTGGGCCTTGCCCACCTACAATAACCACCTCTACAA
GCAAATCTCCAGTGCTTCAACGGGGGCCAGCAACGACAACCACTACTTCGGCTACAGCACCCCTGGGGG
TATTTTGATTTCAACAGATTCCACTGCCATTTCTCACCACGTGACTGGCAGCGACTCATCAACAACAACT
GGGGATTCCGGCCTAAGCGACTCAACTTCAAACTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AATACGGCTACCTGACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTTGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAATTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATCAAAGCCACTAACCCTGTGGCCACCGAAAGATTTGGGACCGTGGCAGTCAATTTCC
AGAGCAGCAGCACAGACCCTGCGACCGGAGATGTGCATGTTATGGGAGCCTTACCTGGAATGGTGTGGCA
AGACAGAGACGTGTACCTGCAGGGTCCCATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6EEEE

MM112 AMINO ACID SEQUENCE (SEQ ID NO:122)
DGYLPDWLEDNLSEGIREWWALKPGVPQPKANQQHQDNRRGLVLPGYKYLGPFNGLD
KGEPVNAADAAALEHDKAYDQQLQAGDNPYLRYNHADAEFQERLQEDTSFGGNLGRAVFQ
AKKRVLEPLGLVEEGAKTAPGKKRPVEQSPQEPDSSSGIGKTGQQPAKKRLNFGQTGDSE
SVPDPQPLGEPPAAPSGVGPNTMAAGSGAPMADNNEGADGVGNASGNWHCDSTWLGDRVI
TTSTRTWALPTYNNHLYKQISSASTGASNDNHYFGYSTPWGYFDFNRFHCHFSPRDWQRL
INNNWGFRPKRLNFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNFQSSSTDPATGDVHVMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6FFFF

MM115 CODING SEQUENCE (SEQ ID NO:123)
GCTGCCGATGGTTATCTTCCAGATTGGCTCGAGGACAACCTCTCTGAGGGCGTTCGAGAGTGGTGGGCGC
TGCAACCTGGAGCCCCTAAACCCAAGGCAAATCAACAACATCAGGACAACGCTCGAGGTCTGGTGCTTCC
GGGTTACAAATACCTTGGACCCGGCAACGGACTCGACAAGGGGGAGCCGGTCAACGCGGCGGACGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAAC
AGCCCGCCAGAAAAAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAGGGTGCCGATGGAGTGGGTAATTCCTCAGGAAATTGGCATTGCGATTCCACATGGC
TGGGCGACAGAGTCATCACCACCAGCACCCGAACATGGGCCTTGCCCACCTACAATAACCACCTCTACAA
GCAAATCTCCAGTGAAACTGCAGGTAGTACCAACGACAACACCTACTTCGGCTACAGCACCCCCTGGGGG
TATTTTGACTTTAACAGATTCCACTGCCATTTCTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
TGGCGTCACGACCATCGCTAATAACCTTACCAGCACGGTTCAAGTCTTCTCGGACTCGGAGTACCAGCTT
CCGTACGTCCTCGGCTCTGCGCACCAGGGCTGCCTCCCTCCGTTCCCGGCGGACGTGTTCATGATTCCGC
AGTACGGCTACCTAACGCTCAACAATGGCAGCCAAGCCGTGGGACGTTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCGCACAGCCAGAGCCTGGACCGGCTGATGAATCCTCTCATCGACCAATACCTGTATT
ACCTGAACAGAACTCAGAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACGAAGACAAGTTCTTTCCCATGAG
CGGTGTCATGATTTTTGGAAAAGAGAGCGCCGGAGCTTCAAACACTGCATTGGACAATGTCATGATCACA
GACGAAGAGGAAATTAAAGCCACTAACCCTGTGGCCACCGAAAGATTTGGGACCGTGGCAGTCAATCTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCTATTTGGGCCAAAATTCCTCACACAGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAGGAAAACAGCAAACGCTGGAATCCCGAAGTGCAGTAT
ACATCTAACTATGCAAAATCTGCCAACGTTGATTTTACTGTGGACAACAATGGACTTTATACTGAGCCTC
GCCCCATTGGCACCCGTTACCTCACCCGTCCCCTGTAA

FIG. 6GGGG

MM115 AMINO ACID SEQUENCE (SEQ ID NO:124)
DGYLPDWLEDNLSEGVREWWALQPGAPKPKANQQHQDNARGLVLPGYKYLGPGNGLD
KGEPVNAADAAALEHDKAYDQQLKAGDNPYLRYNHADAEFQERLQEDTSFGGNLRAVFQ
AKKRVLEPLGLVEEGAKTAPGKKRPVEQSPQEPDSSSGIGKTGQQPARKRLNFGQTGDSE
SVPDPQPLGEPPATPAAVGPTTMASGGGAPMADNNEGADGVGNSSGNWHCDSTWLGDRVI
TTSTRTWALPTYNNHLYKQISSETAGSTNDNTYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDEDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6HHHH

MM120 CODING SEQUENCE (SEQ ID NO:125)
GCTGCCGATGGTTATCTTCCAGATTGGCTCGAGGACAACCTCTCTGAAGGCGTTCGAGAGTGGTGGGCGC
TGAAACCTGGAGCCCCTAAACCCAAGGCAAATCAACAACATCAGGACAACGCTCGAGGTCTTGTGCTTCC
GGGTTACAAATACCTCGGACCCGGCAACGGACTCGACAAGGGGGAGCCGGTCAACGCAGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTTGGTCAGACTGGCGACTCAGAGTCAGTCCCCGACCCACAACCTCT
CGGAGAACCTCCAGCAACCCCCGCTGCTGTGGGACCTACTACAATGGCTGCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACATGGGCCTTGCCCACCTACAATAACCACCTCTACAA
GCAAATCTCCAGTGCTTCAACGGGGGCCAGCAACGACAACCACTACTTCGGCTACAGCACCCCTGGGGG
TATTTTGATTTCAACAGATTCCACTGCCACTTTTCACCACGTGACTGGCAGCGACTCATCAACAACAACT
GGGGATTCCGGCCCAAGAAGCTGCGGTTCAAGCTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGCTG
CCGTACGTCCTCGGCTCTGCGCACCAGGGCTGCCTGCCTCCGTTCCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAACAACTTTGAGTTCAGCTACACTTTTGAGGACGTTCCTTTC
CACAGCAGCTACGCTCACAGCCAGAGTCTGGACCGTCTCATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTTAATGGGCGTG
AATCTATAATCAACCCTGGCACTGCTATGGCCTCACACAAAGACGACGAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATCAAAGCCACTAACCCCGTGGCCACCGAAAGATTTGGGACCGTGGCAGTCAATCTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCCATTTGGGCCAAAATTCCTCACACAGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

*FIG. 6IIII*

MM120 AMINO ACID SEQUENCE (SEQ ID NO:126)
DGYLPDWLEDNLSEGVREWWALKPGAPKPKANQQHQDNARGLVLPGYKYLGPGNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPATPAAVGPTTMAAGGAPMADNNEGADGVGNASGNWHCDSTWLGDRVI
TTSTRTWALPTYNNHLYKQISSASTGASNDNHYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFEFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDEDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

*FIG. 6JJJJ*

MM123 CODING SEQUENCE (SEQ ID NO:127)
GCTGCCGATGGTTATCTTCCAGATTGGCTCGAGGACAACCTCTCTGAAGGCATTCGTGAGTGGTGGGCTC
TGAAACCTGGAGTCCCTCAACCCAAAGCGAACCAACAACACCAGGACAACCGTCGGGGTCTTGTGCTTCC
GGGTTACAAATACCTCGGACCCTTCAACGGACTCGACAAGGGGGAACCCGTCAACGCAGCGGACGCGGCA
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAGC
AGCCCGCTAAAAAGAGACTCAATTTTGGTCAGACTGGCGACTCAGAGTCAGTTCCAGACCCTCAACCTCT
CGGAGAACCTCCAGCAACCCCCGCTGCTGTGGGACCTAATACAATGGCTTCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATCACCACCAGCACCCGAACCTGGGCCTTGCCCACCTATAACAACCACCTCTACAA
GCAAATCTCCAGTGAAACTGCAGGTAGTACCAACGACAACACCTACTTCGGCTACAGCACCCCCTGGGGG
TATTTTGATTTCAACAGATTCCACTGCCACTTCTCACCACGTGACTGGCAGCGACTCATCAACAACAATT
GGGGATTCCGGCCCAAGAGACTCAACTTCAAACTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGCTT
CCGTACGTCCTCGGCTCTGCGCGCCAGGGCTGCCTCCCTCCGTTCCGGCGGACGTGTTCATGATTCCGC
AGTACGGCTACCTAACGCTCAACAATGGCAGCCAGGCAGTGGGACGGTCATCCTTTTACTGCCTGGAATA
TTTCCCATCGCAGATGCTGAGAACGGGCAACAACTTTGAGTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGTGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACGAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCTGTGGCCACCGAAAGATTTGGGACTGTGGCAGTCAATCTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCCATTTGGGCCAAAATTCCTCACACAGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCAGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

FIG. 6KKKK

MM123 AMINO ACID SEQUENCE (SEQ ID NO:128)
DGYLPDWLEDNLSEGIREWWALKPGVPQPKANQQHQDNRRGLVLPGYKYLGPFNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPAKKRLNFGQTGDSE
SVPDPQPLGEPPATPAAVGPNTMASGGGAPMADNNEGADGVGNASGNWHCDSTWLGDRVI
TTSTRTWALPTYNNHLYKQISSETAGSTNDNTYFGYSTPWGYFDFNRFHCHFSPRDWQRL
INNNWGFRPKRLNFKLFNIQVKEVTTNDGVTTIANNLTSTVQVFSDSEYQLPYVLGSARQ
GCLPPFPADVFMIPQYGYLTLNNGSQAVGRSSFYCLEYFPSQMLRTGNNFEFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDEDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6LLLL

MM136 CODING SEQUENCE (SEQ ID NO:129)
GCTGCCGATGGTTATCTTCCAGATTGGCTCGAGGACAACCTCTCTGAGGGCGTTCGAGAGTGGTGGGCGC
TGCAACCTGGAGCCCCTAAACCCAAGGCAAATCAACAACATCAGGACAACGCTCGGGGTCTTGTGCTTCC
GGGTTACAAATACCTCGGACCCGGCAACGGACTCGACAAGGGGGAGCCCGTCAACGCGGCGGACGCAGCG
GCCCTGGAGCACGACAAGGCCTACGACCAGCAGCTCAAAGCGGGAGACAACCCGTACCTGCGGTATAACC
ACGCCGACGCCGAGTTTCAGGAGCGTCTGCAAGAAGATACGTCTTTTGGGGCAACCTCGGGCGAGCAGT
CTTCCAGGCCAAGAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCTAAAAAGAGACTCAATTTTGGTCAGACTGGCGACTCAGAGTCAGTCCCCGATCCACAACCTCT
CGGAGAACCTCCAGCAACCCCCGCTGCTGTGGGACCTACTACAATGGCTTCAGGCGGTGGCGCACCAATG
GCAGACAATAACGAAGGCGCCGACGGAGTGGGTAATGCCTCAGGAAATTGGCATTGCGATTCCACATGGA
TGGGCGACAGAGTCATTACCACCAGCACCCGAACCTGGGCCCTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGACTTCAACAGATTCCACTGCCACTTTTCACCACGTGACTGGCAGCGACTCATCAACAACAATT
GGGGATTCCGGCCCAAGAGACTCAACTTCAAACTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGCTG
CCGTACGTCCTCGGCTCTGCGCACCAGGGCTGCCTCCCTCCGTTCCCGGCGGACGTCTTCATGATTCCTC
AGTACGGCTACCTGACGCTCAACAATGGCAGCCAGGCAGTGGGACGGTCATCCTTTTACTGCCTGGAATA
TTTCCCATCGCAGATGCTGAGAACGGGCAATAACTTTACCTTCAGCTACACCTTTGAGGAAGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAATTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATCACA
GACGAAGAGGAAATCAAAGCCACTAACCCCGTGGCCACCGAAAGATTTGGGACCGTGGCAGTCAATCTCC
AGAGCAGCAGCACAGACCCTGCGACCGGAGATGTGCATGTTATGGGAGCCTTACCTGGAATGGTGTGGCA
AGACAGAGACGTGTACCTGCAGGGTCCCATTTGGGCCAAAATTCCTCACACGGATGGACACTTTCACCCG
TCTCCTCTCATGGGCGGCTTTGGACTCAAGAACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

*FIG. 6MMMM*

MM136 AMINO ACID SEQUENCE (SEQ ID NO:130)
DGYLPDWLEDNLSEGVREWWALQPGAPKPKANQQHQDNARGLVLPGYKYLGPGNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPAKKRLNFGQTGDSE
SVPDPQPLGEPPATPAAVGPTTMASGGGAPMADNNEGADGVGNASGNWHCDSTWMGDRVI
TTSTRTWALPTYNNHLYKQISSETAGSTNDNTYFGYSTPWGYFDFNRFHCHFSPRDWQRL
INNNWGFRPKRLNFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNLQSSSTDPATGDVHVMG
ALPGMVWQDRDVYLQGPIWAKIPHTDGHFHPSPLMGGFGLKNPPPQILIKNTPVPANPPA
EFSATKFASFITQYSTGQVSVEIEWELQKENSKRWNPEVQYTSNYAKSANVDFTVDNNGL
YTEPRPIGTRYLTRPL

*FIG. 6NNNN*

MM138 CODING SEQUENCE (SEQ ID NO:131)
GCTGCCGATGGTTATCTTCCAGATTGGCTCGAGGACAACCTCTCTGAGGGCATTCGCGAGTGGTGGGACC
TGAAACCTGGAGCCCCGAAACCCAAAGCGAACCAACAACACCAGGACAACCGTCGGGGTCTTGTGCTTCC
GGGTTACAAATACCTTGGACCCGGCAACGGACTCGACAAGGGGGAGCCGGTCAACGCAGCAGACGCGGCG
GCCCTCGAGCACGACAAGGCCTACGACCAGCAGCTGCAGGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTTGGTCAGACTGGCGACTCAGAGTCAGTCCCCGACCCACAACCTCT
CGGAGAACCTCCAGCAACCCCCGCTGCTGTGGGACCTACTACAATGGCTTCAGGCGGTGGCGCACCAGTG
GCAGACAATAACGAGGGTGCCGATGGAGTGGGTAATTCCTCAGGAAATTGGCATTGCGATTCCACATGGC
TGGGCGACAGAGTCATCACCACCAGCACCCGAACATGGGCCTTGCCCACCTACAATAACCACCTCTACAA
GCAAATCTCCAGTGCTTCAACGGGGGCCAGCAACGACAACCACTACTTCGGCTACAGCACCCCCTGGGGG
TATTTTGATTTCAACAGATTCCACTGCCACTTTTCACCACGTGACTGGCAGCGACTCATCAACAACAATT
GGGGATTCCGGCCCAAGAGACTCAACTTCAAGCTCTTCAACATCCAAGTCAAGGAGGTCACGACGAATGA
TGGCGTTACGACCATCGCCAATAACCTTACCAGCACGGTTCAAGTGTTTACGGACTCGGAGTACCAGCTG
CCGTACGTCCTCGGCTCTGCGCACCAGGGCTGCCTGCCTCCGTTCCCGGCGGACGTGTTCATGATTCCGC
AATACGGCTACCTGACGCTCAACAATGGCAGCCAGGCAGTGGACGTTCATCCTTTTACTGCCTGGAATA
TTTCCCATCGCAGATGCTGAGAACGGGCAACAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAGAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAATTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATTAAAGCCACTAACCCCGTGGCCACCGAAAGATTTGGGACCGTGGCAGTCAATTTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCCATTTGGGCAAAATTCCTCACACAGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTCACCCGTCCCCTGTAA

*FIG. 6OOOO*

MM138 AMINO ACID SEQUENCE (SEQ ID NO:132)
DGYLPDWLEDNLSEGIREWWDLKPGAPKPKANQQHQDNRRGLVLPGYKYLGPGNGLD
KGEPVNAADAAALEHDKAYDQQLQAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPATPAAVGPTTMASGGGAPVADNNEGADGVGNSSGNWHCDSTWLGDRVI
TTSTRTWALPTYNNHLYKQISSASTGASNDNHYFGYSTPWGYFDFNRFHCHFSPRDWQRL
INNNWGFRPKRLNFKLFNIQVKEVTTNDGVTTIANNLTSTVQVFTDSEYQLPYVLGSAHQ
GCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNFQSSSTDPATGDVHAMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

*FIG. 6PPPP*

MM141 CODING SEQUENCE (SEQ ID NO:133)
GCTGCCGATGGTTATCTTCCAGATTGGCTCGAGGACAACCTCTCTGAAGGCGTTCGAGAGTGGTGGGCGC
TGCAACCTGGAGCCCCTAAACCCAAGGCAAATCAACAACATCAAGACAACGCTCGAGGTCTTGTGCTTCC
GGGTTACAAATACCTTGGACCCGGCAACGGACTCGACAAGGGGGAGCCGGTCAACGCAGCAGACGCGGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATTGGCAAGACAGGCCAGC
AGCCCGCCAGAAAGAGACTCAATTTCGGTCAGACTGGCGACTCAGAGTCAGTCCCCGACCCTCAACCTCT
CGGAGAACCTCCAGCAGCGCCCTCTAGTGTGGGATCTGGTACAATGGCTGCAGGCGGTGGCGCACCAATG
GCAGACAATAACGAAGGCGCCGACGGAGTGGGTAATGCCTCAGGAAATTGGCATTGCGATTCCACATGGC
TGGGCGACAGAGTCATTACCACCAGCACCCGCACCTGGGCCTTGCCCACCTATAACAACCACCTCTACAA
GCAAATCTCCAGTGCTTCAACGGGGGCCAGCAACGACAACCACTACTTCGGCTACAGCACCCCCTGGGGG
TATTTTGACTTTAACAGATTCCACTGCCACTTTTCACCACGTGACTGGCAGCGACTCATCAACAACAACT
GGGGATTCCGGCCCAAGAAGCTGCGGTTTAAACTCTTCAACATCCAAGTCAAGGAGGTCACGACGAATGA
TGGCGTTACGACCATCGCTAATAACCTTACCAGCACGGTTCAAGTCTTCTCGGACTCGGAATACCAGTTG
CCGTACGTCCTCGGCTCTGCGCACCAGGGCTGCCTCCCTCCGTTCCCGGCGGACGTGTTCATGATTCCGC
AATACGGCTACCTAACGCTCAACAATGGCAGCCAGGCAGTGGGACGGTCATCCTTCTACTGCCTGGAATA
TTTCCCATCGCAGATGCTGAGAACGGGCAATAACTTTACCTTCAGCTACACCTTCGAGGACGTGCCTTTC
CACAGCAGCTACGCTCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAACTTTACCTGGACTGGTGCTTCAAAATATAACCTCAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATCACA
GACGAAGAGGAAATTAAAGCCACTAACCCCGTGGCCACCGAAAGATTTGGGACCGTGGCAGTCAATCTCC
AGAGCAGCAGCACAGACCCTGCGACCGGAGATGTGCATGCTATGGGAGCATTACCTGGCATGGTGTGGCA
AGATAGAGACGTATACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAT
ACATCTAACTATGCAAAATCTGCCAACGTTGATTTTACTGTGGACAACAATGGACTTTATACTGAGCCTC
GCCCCATTGGCACCCGTTACCTCACCCGTAATCTGTAA

*FIG. 6QQQQ*

MM141 AMINO ACID SEQUENCE (SEQ ID NO:134)
DGYLPDWLEDNLSEGVREWWALQPGAPKPKANQQHQDNARGLVLPGYKYLGPGNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPAAPSSVGSGTMAAGGGAPMADNNEGADGVGNASGNWHCDSTWLGDRVI
TTSTRTWALPTYNNHLYKQISSASTGASNDNHYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRNL

*FIG. 6RRRR*

MM144 CODING SEQUENCE (SEQ ID NO:135)

GCTGCCGATGGTTATCTTCCAGATTGGCTCGAGGACAACCTCTCTGAGGGCATTCGCGAGTGGTGGGACT
TGAAACCTGGAGCCCCTCAACCCAAGGCAAATCAACAACATCAAGACAACGCTCGAGGTCTTGTGCTTCC
GGGTTACAAATACCTCGGACCCGGCAACGGACTCGACAAGGGGGAGCCCGTCAACGCGGCGGATGCAGCG
GCCCTCGAGCACGACAAGGCCTACGACCAGCAGCTCAAAGCGGGTGACAATCCGTACCTGCGGTATAACC
ACGCCGACGCCGAGTTTCAGGAGCGTCTGCAAGAAGATACGTCTTTTGGGGGCAACCTCGGGCGAGCAGT
CTTCCAGGCCAAGAAGCGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTCGGTCAGACTGGCGACTCAGAGTCAGTTCCAGACCCTCAACCTCT
CGGAGAACCTCCAGCAGCGCCCTCTAGTGTGGGATCTGGTACAGTGGCTGCAGGCGGTGGCGCACCAATG
GCAGACAATAACGAAGGTGCCGACGGAGTGGGTAATGCCTCAGGAAATTGGCATTGCGATTCCACATGGC
TGGGCGACAGAGTCATCACCACCAGCACCCGAACCTGGGCCCTGCCCACCTACAACAACCACCTCTACAA
GCAAATCTCCAGTGAAACTGCAGGTAGTACCAACGACAACACCTACTTCGGCTACAGCACCCCTGGGGG
TATTTTGACTTTAACAGATTCCACTGCCACTTCTCACCACGTGACTGGCAGCGACTCATCAACAACAACT
GGGGATTCCGGCCCAAGAGACTCAACTTCAAGCTCTTCAACATCCAAGTCAAGGAGGTCACGACGAATGA
TGGCGTCACAACCATCGCTAATAACCTTACCAGCACGGTTCAAGTCTTCTCGGACTCGGAGTACCAGCTG
CCGTACGTCCTCGGCTCTGCGCACCAGGGCTGCCTCCCTCCGTTCCGGCGGACGTGTTCATGATTCCGC
AATACGGCTACCTAACGCTCAACAATGGCAGCCAGGCAGTGGGACGGTCATCCTTTTACTGCCTGGAATA
TTTCCCATCGCAGATGCTGAGAACGGGCAATAACTTTACCTTCAGCTACACCTTCGAGGACGTGCCTTTC
CACAGCAGCTACGCGCACAGCCAGAGCCTGGACCGGCTGATGAATCCTCTCATCGACCAGTACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTATCGGCAGCAGCGCGTTTCTAAA
ACAAAAACAGACAACAACAACAGCAATTTTACCTGGACTGGTGCTTCAAAATATAACCTTAATGGGCGTG
AATCTATAATCAACCCTGGCACTGCTATGGCCTCACACAAAGACGACAAAGACAAGTTCTTTCCCATGAG
CGGTGTCATGATTTTTGGAAAGGAGAGCGCCGGAGCTTCAAACACTGCATTGGACAATGTCATGATTACA
GACGAAGAGGAAATTAAAGCCACTAACCCCGTGGCCACCGAAAGATTTGGGACTGTGGCAGTCAATCTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCCATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCGGAGTTTTCGGCTACAAAGTTTGCTTCATTCATCACCCAGTATTCCACAGGACA
AGTGAGCGTGGAGATTGAATGGGAGCTGCAGAAAGAAAACAGCAAGCGCTGGAATCCCGAAGTGCAGTAC
ACATCCAATTATGCAAAATCTGCCAACGTTGATTTACTGTGGACAACAATGGACTTTATACTGAGCCTC
GCCCCATTGGCACCCGTTACCTTACCCGTCCCCTGTAA

FIG. 6SSSS

MM144 AMINO ACID SEQUENCE (SEQ ID NO:136)

DGYLPDWLEDNLSEGIREWWDLKPGAPQPKANQQHQDNARGLVLPGYKYLGPGNGLD
KGEPVNAADAAALEHDKAYDQQLKAGDNPYLRYNHADAEFQERLQEDTSFGGNLGRAVFQ
AKKRVLEPLGLVEEGAKTAPGKKRPVEQSPQEPDSSSGIGKTGQQPARKRLNFGQTGDSE
SVPDPQPLGEPPAAPSSVGSGTVAAGGGAPMADNNEGADGVGNASGNWHCDSTWLGDRVI
TTSTRTWALPTYNNHLYKQISSETAGSTNDNTYFGYSTPWGYFDFNRFHCHFSPRDWQRL
INNNWGFRPKRLNFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEDVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDKDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6TTTT

MM153 CODING SEQUENCE (SEQ ID NO:137)
GCTGCCGATGGTTATCTTCCAGATTGGCTCGAGGACACTCTCTCTGAAGGAATAAGACAGTGGTGGAAGC
TCAAACCTGGCCCACCACCACCAAAGCCCGCAGAGCGGCATAAGGACGACAGCAGGGGTCTTGTGCTTCC
TGGGTACAAGTACCTCGGACCCTTCAACGGACTCGACAAGGGAGAGCCGGTCAACGAGGCAGACGCCGCG
GCCCTCGAGCACGACAAAGCCTACGACCGGCAGCTCGACAGCGGAGACAACCCGTACCTCAAGTACAACC
ACGCCGACGCGGAGTTTCAGGAGCGCCTTAAAGAAGATACGTCTTTTGGGGGCAACCTCGGACGAGCAGT
CTTCCAGGCCAAAAAGAGGGTTCTCGAACCTCTCGGTCTGGTTGAGGAAGGCGCTAAGACGGCTCCTGGA
AAGAAACGTCCGGTAGAGCAGTCGCCACAAGAGCCAGACTCCTCCTCGGGCATCGGCAAGACAGGCCAGC
AGCCCGCCAGAAAGAGACTCAATTTCGGTCAGACTGGCGACTCAGAGTCAGTCCCAGACCCTCAACCTCT
CGGAGAACCTCCAGCAGCCCCCACAAGTTTGGGACCTACTACAATGGCTTCAGGCGGTGGCGCACCAATG
GCAGACAATAACGAAGGTGCCGACGGAGTGGGTAATGCCTCAGGAAATTGGCATTGCGATTCCACATGGC
TGGGCGACAGAGTCATTACCACCAGCACCCGAACCTGGGCCCTGCCCACCTACAACAACCACCTCTACAA
GCAAATCTCCAGTGAAACTGCAGGTAGTACCAACGACAACACCTACTTCGGCTACAGCACCCCCTGGGGG
TATTTTGATTTCAACAGATTCCACTGCCATTTCTCACCACGTGACTGGCAGCGACTCATCAACAACAACT
GGGGATTCCGGCCCAAGAAGCTGCGGTTCAAGCTCTTCAACATCCAGGTCAAGGAGGTCACGACGAATGA
CGGCGTTACGACCATCGCTAATAACCTTACCAGCACGGTTCAAGTCTTCTCGGACTCGGAGTACCAGTTG
CCGTACGTCCTCGGCTCTGCGCACCAGGGCTGCCTCCCTCCGTTCCCGGCGGACGTGTTCATGATTCCGC
AGTACGGCTACCTGACGCTCAACAATGGCAGCCAGGCAGTGGGACGGTCATCCTTTTACTGCCTGGAATA
TTTCCCATCGCAGATGCTGAGAACGGGCAACAACTTTACCTTCAGCTACACCTTTGAGGAAGTGCCTTTC
CACAGCAGCTACGCTCACAGCCAGAGTCTGGACCGTCTGATGAATCCTCTCATCGACCAGTACCTGTATT
ACCTGAACAGAACTCAAAATCAGTCCGGAAGTGCCCAAAACAAGGACTTGCTGTTTAGCCGGGGGTCTCC
AGCTGGCATGTCTGTTCAGCCCAAAAACTGGCTACCTGGACCCTGTTACCGGCAGCAGCGCGTTTCTAAA
ACAAAAACAGACAACAACAACAGCAACTTTACCTGGACTGGTGCTTCAAAATATAACCTCAATGGGCGTG
AATCCATCATCAACCCTGGCACTGCTATGGCCTCACACAAAGACGACGAAGACAAGTTCTTTCCCATGAG
CGGTGTCATGATTTTTGGAAAAGAGAGCGCCGGAGCTTCAAACACTGCATTGGACAATGTCATGATTACA
GACGAAGAGGAAATTAAAGCCACTAACCCTGTGGCCACCGAAAGATTTGGGACTGTGGCAGTCAATCTCC
AGAGCAGCAGCACAGACCCTGCGACCGGAGATGTGCATGCTATGGGAGCATTACCTGGCATGGTGTGGCA
AGATAGAGACGTGTACCTGCAGGGTCCTATTTGGGCCAAAATTCCTCACACGGATGGACACTTTCACCCG
TCTCCTCTCATGGGCGGCTTTGGACTTAAGCACCCGCCTCCTCAGATCCTCATCAAAAACACGCCTGTTC
CTGCGAATCCTCCGGCAGAGTTTTCGGCTACAAAGTTTGCTTCATTCATCACCCAGTATTCCACAGGACA
AGTGAGCGTGGAGATTGAATGGGAGCTGCAGAAAGAAAACAGCAAACGCTGGAATCCCGAAGTGCAGTAC
ACATCCAATTATGCAAAATCTGCCAACGTTGATTTTACTGTGGACAACAATGGACTTTATACTGAGCCTC
GCCCCATTGGCACCCGTTACCTTACCCGTCCCCTGTAA

FIG. 6UUUU

MM153 AMINO ACID SEQUENCE (SEQ ID NO:138)
DGYLPDWLEDTLSEGIRQWWKLKPGPPPPKPAERHKDDSRGLVLPGYKYLGPFNGLD
KGEPVNEADAAALEHDKAYDRQLDSGDNPYLKYNHADAEFQERLKEDTSFGGNLGRAVFQ
AKKRVLEPLGLVEEGAKTAPGKKRPVEQSPQEPDSSSGIGKTGQQPARKRLNFGQTGDSE
SVPDPQPLGEPPAAPTSLGPTTMASGGGAPMADNNEGADGVGNASGNWHCDSTWLGDRVI
TTSTRTWALPTYNNHLYKQISSETAGSTNDNTYFGYSTPWGYFDFNRFHCHFSPRDWQRL
INNNWGFRPKKLRFKLFNIQVKEVTTNDGVTTIANNLTSTVQVFSDSEYQLPYVLGSAHQ
GCLPPFPADVFMIPQYGYLTLNNGSQAVGRSSFYCLEYFPSQMLRTGNNFTFSYTFEEVP
FHSSYAHSQSLDRLMNPLIDQYLYYLNRTQNQSGSAQNKDLLFSRGSPAGMSVQPKNWLP
GPCYRQQRVSKTKTDNNNSNFTWTGASKYNLNGRESIINPGTAMASHKDDEDKFFPMSGV
MIFGKESAGASNTALDNVMITDEEEIKATNPVATERFGTVAVNLQSSSTDPATGDVHAMG
ALPGMVWQDRDVYLQGPIWAKIPHTDGHFHPSPLMGGFGLKHPPPQILIKNTPVPANPPA
EFSATKFASFITQYSTGQVSVEIEWELQKENSKRWNPEVQYTSNYAKSANVDFTVDNNGL
YTEPRPIGTRYLTRPL

FIG. 6VVVV

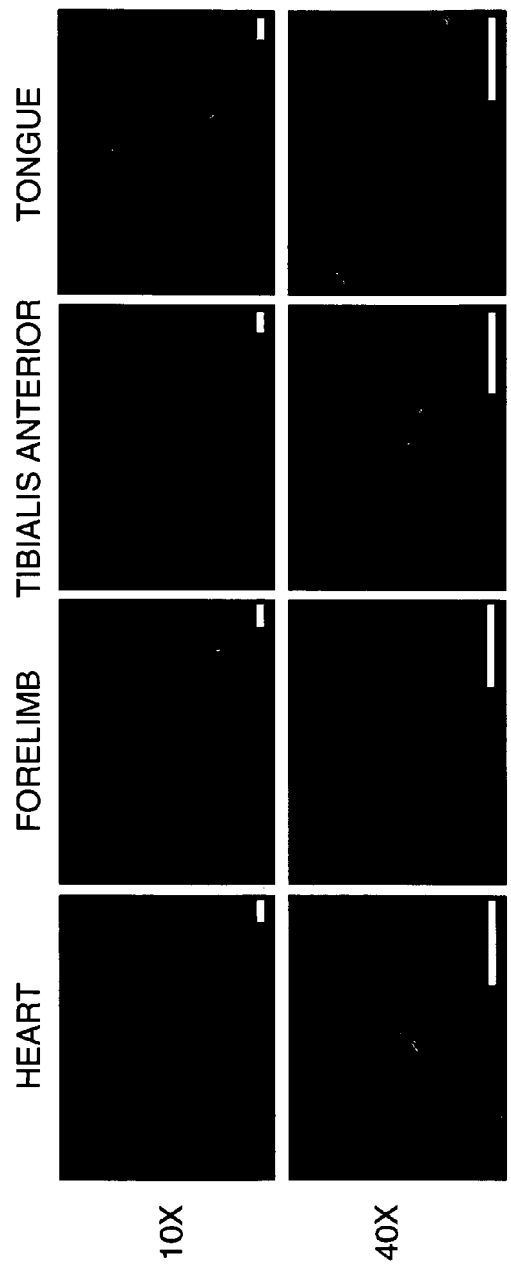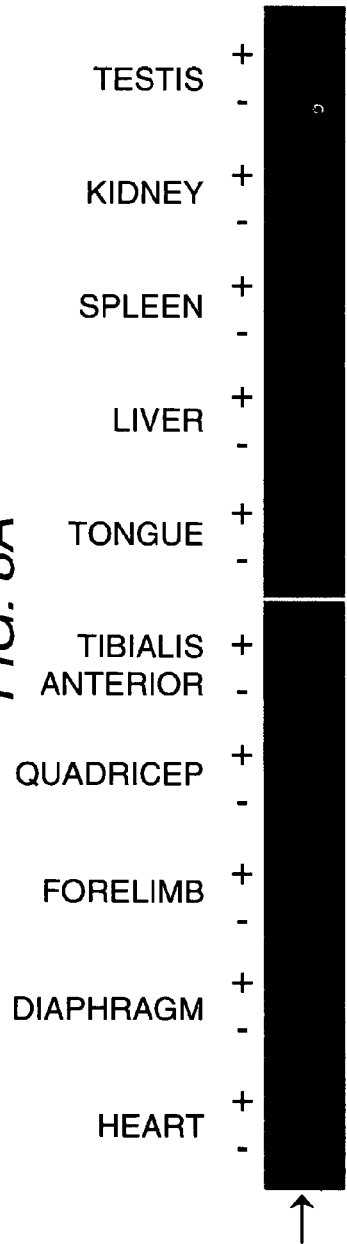
FIG. 8A
FIG. 8B

DIRECTED EVOLUTION AND IN VIVO PANNING OF VIRUS VECTORS

RELATED APPLICATION INFORMATION

This application claims priority under 35 U.S.C. §371 from PCT Application No. PCT/US2009/002608, filed Apr. 29, 2009, which claims the benefit of U.S. Provisional Application No. 61/049,160 filed Apr. 30, 2008, the disclosures of which are incorporated by reference herein in their entirety.

STATEMENT OF FEDERAL SUPPORT

Aspects of this invention were supported with funding provided under Grant No. 2RO1AR 45967 awarded by the National Institutes of Health. The United States Government has certain rights in this invention.

FIELD OF THE INVENTION

The invention relates to methods for directed evolution and in vivo panning of adeno-associated virus vectors as well as optimized AAV capsids and virus vectors comprising the same.

BACKGROUND OF THE INVENTION

The muscular dystrophies (MD) are a heterogeneous group of inherited disorders characterized by progressive weakness and degeneration of skeletal muscles. The molecular basis of Duchenne muscular dystrophy (DMD) was first elucidated twenty years ago as a perturbation of dystrophin (Koenig et al., (1987) *Cell* 50: 509-517). Dystrophin associates with a number of proteins to form a large oligomeric complex named the dystrophin-glycoprotein complex (DGC), which bridges across the sarcolemma and connects the extracellular matrix and the actin cytoskeleton (Allamand and Campbell, (2000) *Human Molecular Genetics* 9:2459-2467). Loss or abnormal function of the DGC components will lead to dystrophic muscles and various forms of MD. For instance, mutations in sarcoglycan (SG) genes are responsible for autosomal recessive limb-girdle muscular dystrophies (LGMD 2C-2F; reviewed by Lim and Campbell, (1998) *Neurology* 11:443-452), and deficiency in the laminin α2 chain is responsible for about half of the cases of congenital muscular dystrophy (CMD; Helbling-Leclerc et al., (1995) *Nature Genetics* 11:216-218).

Adeno-associated virus (AAV) was first reported to efficiently transduce muscle over ten years ago (Xiao et al., (1996) *J. Virology* 70:8098-8108). As another advantage, AAV vectors have a good safety profile. The recombinant AAV (rAAV) genome composed of a foreign expression cassette and AAV inverted terminal repeat (ITR) sequences exists in eukaryotic cells in an episomal form that is responsible for persistent transgene expression (Schnepp et al., (2003) *J. Virology* 77:3495-3504). No human disease has been associated with wild-type AAV infection and low toxicity is observed in human subjects following muscle transduction by rAAV (Manno et al., (2003) *Blood* 101:2963-2972).

A series of new AAV serotypes have been identified from humans or primates that display variable capsid sequences as compared with AAV2 (Gao et al., (2002) *Proc. Nat. Acad. Sci. USA* 99:11854-11859; Gao et al., (2004) *J. Virology* 78:6381-6388). Of these, AAV1, 6, 8, and 9 recombinant vectors have been reported to result in higher transgene expression level in muscle than rAAV2 vector (Wang et al., (2005) *Nature Biotech.* 23:321-328; Inagaki et al., (2006) *Molecular Therapy* 14:45-53). Widespread transduction of cardiac and skeletal muscle has been achieved in adult mouse by intravenous administration of rAAV6 vector supplemented with vascular endothelium growth factor (VEGF) (Gregorevic et al., (2004) *Nature Med.* 10:828-834). rAAV1 vectors have a similar capsid sequence and were successfully applied in systemic gene delivery to vital muscles of DMD and CMD mouse models and efficiently ameliorated the dystrophic phenotype (Qiao et al., (2005) *Proc. Nat. Acad. Sci. USA* 102:11999-12004; Denti et al., (2006) *Proc. Nat. Acad. Sci. USA* 103: 3758-3763). Whilst vector administration in these studies was conducted with pharmacological interventions or in neonatal animals, rAAV8 vectors appear more efficient at crossing the blood vessel barrier and transducing heart and skeletal muscle of adult mice and hamsters (Wang et al., (2005) *Nature Biotech.* 23:321-328; Zhu et al., (2005) *Circulation* 112:2650-2659). AAV9 vectors also demonstrate efficient tropism to the myocardium and serve as another alternative for systemic gene delivery to heart (Inagaki et al., (2006) *Molecular Therapy* 14:45-53; Pacak et al., (2006) *Circulation Research* 99:3-9).

In addition to the investigation of natural AAV serotypes, research efforts have explored modification of the AAV capsid to produce optimized vectors. Mutagenesis represented the initial approach to genetically modify the AAV2 capsid (Wu et al., (2000) *J. Virology* 74:8635-8647; Lochrie et al., (2006) *J. Virology* 80:821-834). Insertion of peptides from phage display libraries into the AAV capsid protein proved to be another strategy to modify the AAV capsid and retarget the vector to new cells or tissues. This method has been further developed to directly display synthesized peptides on the surface of the AAV capsid.

Besides rational design, directed evolution has been used to introduce modifications into AAV vectors. One group reported that the AAV2 capsid gene was diversified by random mutagenesis and then subject to in vitro recombination (Maheshri et al., (2006) *Nature Biotech.* 24:198-204). The modified capsid genes were employed for the production of an AAV library, which was screened in vitro for enhanced properties such as altered affinities for heparin or evasion of antibody neutralization. In vitro screening methods, however, are inherently limited in their ability to identify optimized mutants that will have desired properties in vivo in the context of a complex biological system. For example, the vasculature is a major barrier for systemic AAV delivery via the circulation to many tissues and cell types including skeletal muscle, diaphragm muscle, the heart and brain. It would be desirable for an AAV vector to not only be efficient in crossing the endothelial lining to reach the intended target cells such as cardiomyocytes in the heart, myofibers in skeletal muscle and neurons in the brain, but also be robust in infecting those intended cells after reaching them. An in vitro panning system is simply unable to select for both of these properties. In addition, there are numerous examples in the literature in which in vitro assessment of viral properties such as tropism was not predictive of in vivo behavior.

SUMMARY OF THE INVENTION

The present invention provides methods of achieving directed evolution of viruses by in vivo screening or "panning" to identify viruses comprising mosaic or "scrambled" AAV capsids having characteristics of interest, e.g., tropism profile and/or neutralization profile (e.g., ability to evade neutralizing antibodies). The invention also provides scrambled AAV capsids and virus particles comprising the same.

Thus, as one aspect, the invention provides a nucleic acid (e.g., an isolated nucleic acid) encoding an AAV capsid, the nucleic acid comprising an AAV capsid coding sequence selected from the group consisting of:

(a) the nucleotide sequence of FIG. 3E (M17) (SEQ ID NO:1);
(b) the nucleotide sequence of FIG. 3H (M22) (SEQ ID NO:3);
(c) the nucleotide sequence of FIG. 3K (M35) (SEQ ID NO:5);
(d) the nucleotide sequence of FIG. 3B (M41) (SEQ ID NO:7);
(e) the nucleotide sequence of FIG. 3N (M42) (SEQ ID NO:9);
(f) the nucleotide sequence of FIG. 3Q (M62) (SEQ ID NO:11);
(g) the nucleotide sequence of FIG. 3T (M67) (SEQ ID NO:13);
(h) the nucleotide sequence of FIG. 3W (M125) (SEQ ID NO:15);
(i) the nucleotide sequence of FIG. 3Z (M148) (SEQ ID NO:17);
(j) the nucleotide sequence of FIG. 3CC (M151) (SEQ ID NO:19);
(k) the nucleotide sequence of FIG. 3FF (H18) (SEQ ID NO:21);
(l) the nucleotide sequence of FIG. 3II (H34) (SEQ ID NO:23);
(m) the nucleotide sequence of FIG. 3LL (H39) (SEQ ID NO:25);
(n) the nucleotide sequence of FIG. 3OO (H40) (SEQ ID NO:27);
(o) the nucleotide sequence of FIG. 3RR (H43) (SEQ ID NO:29);
(p) the nucleotide sequence of FIG. 3UU (H50) (SEQ ID NO:31);
(q) the nucleotide sequence of FIG. 3XX (H53) (SEQ ID NO:33);
(r) the nucleotide sequence of FIG. 3AAA (H66) (SEQ ID NO:35);
(s) the nucleotide sequence of FIG. 3DDD (H109) (SEQ ID NO:37);
(t) the nucleotide sequence of FIG. 6A (HH1) (SEQ ID NO:39);
(u) the nucleotide sequence of FIG. 6C (HH15) (SEQ ID NO:41);
(vv) the nucleotide sequence of FIG. 6E (HH19) (SEQ ID NO:43);
(ww) the nucleotide sequence of FIG. 6G (HH27) (SEQ ID NO:45);
(xx) the nucleotide sequence of FIG. 6I (HH35) (SEQ ID NO:47);
(yy) the nucleotide sequence of FIG. 6K (HH41) (SEQ ID NO:49);
(zz) the nucleotide sequence of FIG. 6M (HH45) (SEQ ID NO:51);
(aaa) the nucleotide sequence of FIG. 6O (HH53) (SEQ ID NO:53);
(bbb) the nucleotide sequence of FIG. 6Q (HH67) (SEQ ID NO:55);
(ccc) the nucleotide sequence of FIG. 6S (HH68) (SEQ ID NO:57);
(ddd) the nucleotide sequence of FIG. 6U (HH75) (SEQ ID NO:59);
(eee) the nucleotide sequence of FIG. 6W (HH87) (SEQ ID NO:61);
(fff) the nucleotide sequence of FIG. 6Y (HH64) (SEQ ID NO:63);
(ggg) the nucleotide sequence of FIG. 6AA (MH4) (SEQ ID NO:65);
(hhh) the nucleotide sequence of FIG. 6CC (MH18) (SEQ ID NO:67);
(iii) the nucleotide sequence of FIG. 6EE (MH21) (SEQ ID NO:69);
(jjj) the nucleotide sequence of FIG. 6GG (MH31) (SEQ ID NO:71);
(kkk) the nucleotide sequence of FIG. 6II (MH39) (SEQ ID NO:73);
(lll) the nucleotide sequence of FIG. 6KK (MHY43) (SEQ ID NO:75);
(mmm) the nucleotide sequence of FIG. 6MM (MH47) (SEQ ID NO:77);
(nnn) the nucleotide sequence of FIG. 6OO (MH58) (SEQ ID NO:79);
(ooo) the nucleotide sequence of FIG. 6QQ (MH63) (SEQ ID NO:81);
(ppp) the nucleotide sequence of FIG. 6SS (MH71) (SEQ ID NO:83);
(qqq) the nucleotide sequence of FIG. 6UU (MH74) (SEQ ID NO:85);
(rrr) the nucleotide sequence of FIG. 6WW (MH78) (SEQ ID NO:87);
(sss) the nucleotide sequence of FIG. 6YY (MH82) (SEQ ID NO:89);
(ttt) the nucleotide sequence of FIG. 6AAA (MH90) (SEQ ID NO:91);
(uuu) the nucleotide sequence of FIG. 6CCC (MH94) (SEQ ID NO:93);
(vvv) the nucleotide sequence of FIG. 6EEE (MH95) (SEQ ID NO:95);
(www) the nucleotide sequence of FIG. 6GGG (MH107) (SEQ ID NO:97);
(xxx) the nucleotide sequence of FIG. 6III (MH113) (SEQ ID NO:99);
(yyy) the nucleotide sequence of FIG. 6KKK (MM4) (SEQ ID NO:101);
(zzz) the nucleotide sequence of FIG. 6MMM (MM7) (SEQ ID NO:103);
(aaaa) the nucleotide sequence of FIG. 6OOO (MM19) (SEQ ID NO:105);
(bbbb) the nucleotide sequence of FIG. 6QQQ (MM35) (SEQ ID NO:107);
(cccc) the nucleotide sequence of FIG. 6SSS (MM44) (SEQ ID NO:109);
(dddd) the nucleotide sequence of FIG. 6UUU (MM55) (SEQ ID NO:111);
(eeee) the nucleotide sequence of FIG. 6WWW (MM65) (SEQ ID NO:113);
(ffff) the nucleotide sequence of FIG. 6YYY (MM68) (SEQ ID NO:115);
(gggg) the nucleotide sequence of 6AAAA (MM84) (SEQ ID NO:117);
(hhhh) the nucleotide sequence of FIG. 6CCCC (MM107) (SEQ ID NO:119);
(iiii) the nucleotide sequence of FIG. 6EEEE (MM112) (SEQ ID NO:121);
(jjjj) the nucleotide sequence of FIG. 6GGGG (MM115) (SEQ ID NO:123);
(kkkk) the nucleotide sequence of FIG. 6IIII (MM120) (SEQ ID NO:125);

(llll) the nucleotide sequence of FIG. 6KKKK (MM123) (SEQ ID NO:127);

(mmmm) the nucleotide sequence of FIG. 6MMMM (MM136) (SEQ ID NO:129);

(nnnn) the nucleotide sequence of FIG. 6OOOO (MM138) (SEQ ID NO:131);

(oooo) the nucleotide sequence of FIG. 6QQQQ (MM141) (SEQ ID NO:133);

(pppp) the nucleotide sequence of FIG. 6SSSS (MM144) (SEQ ID NO:135), (rrrr) or the nucleotide sequence of FIG. 6UUUU (MM153) (SEQ ID NO:137); and (rrrr) a nucleotide sequence that encodes an AAV capsid encoded by the nucleotide sequence of any of (a) to (qqqq) but that differs from the nucleotide sequences of (a) to (qqqq) due to the degeneracy of the genetic code.

As an additional aspect, the invention provides AAV capsids encoded by the nucleic acids of the invention.

The invention further provides viral particles comprising a virus genome (e.g., an AAV genome); and an AAV capsid of the invention, wherein the AAV capsid encapsidates the virus genome. In particular embodiments, the virus genome is a recombinant vector genome comprising a heterologous nucleic acid.

Still further, the invention provides a pharmaceutical formulation comprising a nucleic acid, AAV capsid or virus particle of the invention in a pharmaceutically acceptable carrier.

As a further aspect, the invention provides a method of producing a recombinant virus particle comprising an AAV capsid (e.g., AAV particle), the method comprising:

providing a cell in vitro with a nucleic acid of the present invention, an AAV rep coding sequence, a recombinant vector genome (e.g., a rAAV genome) comprising a heterologous nucleic acid, and helper functions for generating a productive infection; and allowing assembly of the recombinant virus particle comprising the AAV capsid and encapsidating the recombinant vector genome.

The invention further provides methods of delivering a nucleic acid of interest to a cell, the method comprising administering a nucleic acid, virus particle or AAV capsid of the invention to the cell.

As still another aspect, the invention provides a method of delivering a nucleic acid of interest to a mammalian subject, the method comprising:

administering an effective amount of a virus particle, nucleic acid, pharmaceutical formulation or AAV capsid of the invention to a mammalian subject.

As yet another aspect, the invention provides a method of treating muscular dystrophy in a subject in need thereof, the method comprising:

administering an effective amount of a virus particle (e.g., an AAV particle) or a pharmaceutical formulation comprising a virus particle of the invention to the mammalian subject, wherein the virus particle comprises a heterologous nucleic acid encoding dystrophin, a mini-dystrophin, a micro-dystrophin, a laminin-α2, a mini-agrin, an α-sarcoglycan, β-sarcoglycan, a γ-sarcoglycan, a δ-sarcoglycan, utrophin, Fukutin-related protein, myostatin pro-peptide, follistatin, dominant negative myostatin, an angiogenic factor and/or an anti-apoptotic factor.

Still further, the invention provides a method of treating congenital heart failure in a subject in need thereof, the method comprising:

administering an effective amount of a virus particle (e.g., an AAV particle) or pharmaceutical formulation comprising a virus particle of the invention to the mammalian subject, wherein the AAV particle comprises a heterologous nucleic acid encoding a sarcoplasmic endoreticulum $Ca^{2+}$-ATPase (SERCA2a), a β-adrenergic receptor kinase inhibitor (βARKct), inhibitor 1 of protein phosphatase 1, an anti-apoptotic factor and/or an angiogenic factor.

The invention also encompasses a method of identifying a virus vector (e.g., an AAV vector) or AAV capsid having a tropism profile of interest, the method comprising:

(a) providing a collection of virus vectors (e.g., AAV vectors), wherein each virus vector within the collection comprises:

(i) an AAV capsid comprising capsid proteins generated by shuffling the capsid coding sequences of two or more different AAV, wherein the capsid amino acid sequences of the two or more different AAV differ by at least two amino acids; and (ii) a virus vector genome (e.g., an AAV vector genome) comprising:

a cap coding sequence encoding the AAV capsid of (i);

an AAV rep coding sequence; and at least one terminal repeat that functions with the Rep protein(s) encoded by the AAV rep coding sequence (e.g., 5' and/or 3' terminal repeats such as 5' and/or 3' AAV terminal repeats);

wherein the AAV capsid encapsidates the virus vector genome;

(b) administering the collection of virus vectors to a mammalian subject; and (c) recovering a plurality of virus vectors as virions or as viral genomes encoding the AAV capsid from a target tissue, thereby identifying a virus vector or AAV capsid having a tropism of interest.

These and other aspects of the invention are set forth in more detail in the description of the invention below.

BRIEF DESCRIPTION OF THE DRAWINGS

FIG. 1 shows Taqα I digested capsid genes of random clones from the plasmid library. The progeny capsid gene clones and parental capsid gene clones are indicated. Numbers 1-9 show capsid genotypes of the corresponding AAV serotypes. "M" is the 100 base pair DNA size ladder. "R" designates recombinant.

FIG. 2 shows the frequencies of AAV clones retrieved from skeletal muscle and liver after two rounds of in vivo panning. Forty three unique AAV mutants were identified from muscle after the first round of screening by their unique capsid sequences. Those infectious plasmids were then mixed for production of a virus library for the second round of biopanning in skeletal muscle after i.v. injection. Only those mutants appearing more than once in the muscle are shown. Among the 79 randomly retrieved mutants, 19 capsid sequences were found unique.

FIG. 3 depicts the structure and sequence of the mosaic capsid genes. The deduced M41 capsid amino acid (AA) sequence was aligned with that of the eight parental AAV serotypes to determine their phylogenetic relationship (FIG. 3A). Different fill patterns of the sequence segments represent the AAV serotype of origin (i.e., 1, 6, 7 and 8). One residue replacement distinct from any known AAV capsid (tyrosine 418) is indicated with a triangle. AA residue numbers begin from the start of the capsid open reading frame. FIG. 3B and FIG. 3C respectively depict the nucleotide and amino acid sequence of the M41 capsid gene. FIGS. 3D-3DD depict the structure, nucleotide and amino acid sequence of mosaic capsid genes from vectors with skeletal muscle tropism, whereas FIGS. 3EE-3EEE depict the structure, nucleotide and amino acid sequence of mosaic capsid genes from vectors with heart tropism.

FIG. 5 shows the results of systemic delivery of LacZ transgene by AAVM41 into striated muscles.

FIG. 6 depicts the nucleic acid and amino acid sequences of mosaic AAV capsids following reshuffling, generation of secondary libraries, and screening in vivo in heart and skeletal muscle tissue. The AAV capsid clones identified in Example 2 by screening heart tissue were reshuffled to generate a secondary heart library. Similarly, a secondary skeletal muscle library was generated from the capsid mutants identified in Example 4 in skeletal muscle. The secondary heart library was subjected to three successive screenings to identify those AAV capsid clones targeting heart ("HH" designation; FIGS. 6H to 6Z). The secondary skeletal muscle library was used for parallel screening for capsid clones targeting heart (designated "MH"; FIGS. 6AA to 6JJJ) and skeletal muscle (designated "MM"; FIGS. 6KKK to 6VVVV).

FIG. 7 shows a comparison of gene transfer efficiency in primary cardiomyocytes or skeletal muscles.

FIG. 8 depicts the results of studies of systemic delivery of δ-sarcoglycan into cardiomyopathic hamster for treatment of heart failure. $1 \times 10^{12}$ vector genomes of M41-Syn-δSG vector were injected into 7-week-old male TO-2 hamsters via the jugular vein (n=5). (FIG. 8A) Immunofluorescent staining of δ-sarcoglycan on thin sections of heart and skeletal muscle tissues 4 months after vector administration. Two magnifications were used for clear view and the scale bars represent 50 µm. (FIG. 8B) Western analysis of δ-sarcoglycan in muscle and non-muscle tissues from untreated TO-2 (−) and rM41 vector-treated TO-2 (+) hamsters. 20 µg of total proteins were loaded in each lane.

DETAILED DESCRIPTION OF THE INVENTION

Figure 4A:
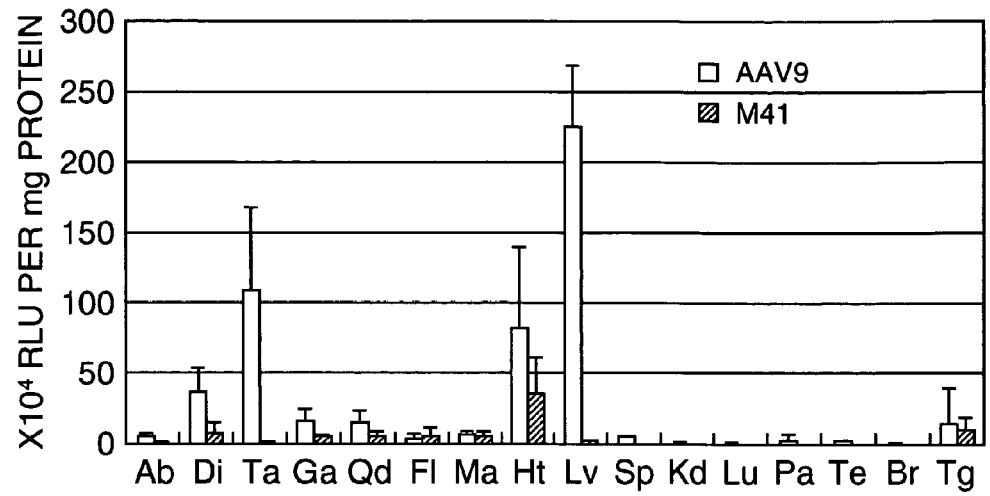
FIG. 4 shows luciferase activities and vector genome copy numbers in various mouse tissues after systemic administration of AAV vectors. Comparison of AAV9- and AAVM41-CMV-Luc vectors in luciferase activities (FIG. 4A), and AAV vector genome copy numbers (FIG. 4B), at 2-weeks after intravenous injection of $3 \times 10^{11}$ vector genomes in mice. Similar comparison of AAV6- or M41-CMV-Luc vectors in luciferase activities (FIG. 4C), and AAV genome copy numbers (FIG. 4D). Data are mean values±s.d. Ab, abdomen muscle; Di, diaphragm; Ta, tibialis anterior; Ga, gastrocnemius; Qd, quadriceps; Fl, forelimb; Ma, masseter; Ht, heart; Lv, liver; Sp, spleen; Kd, kidney; Lu, lung; Pa, pancreas; Te, testis; Br, brain; Tg, tongue. Heart vs. liver ratio in transduction efficiency by three rAAV vectors on luciferase activities (FIG. 4E), and vector genome copy numbers (FIG. 4F).

The present invention is based, in part, on the inventors' discovery that directed evolution and in vivo panning can be used to identify scrambled AAV capsids and viruses comprising the same having desired characteristics such as tropism profile and/or neutralization profile (e.g., ability to evade neutralizing antibodies) by scrambling AAV capsid sequences from two or more different AAV capsids and then screening directly in vivo. In general, the methods of the invention are carried out to identify novel AAV capsids comprising modifications in the nucleic acid coding sequence(s) and/or amino acid sequence(s) for one, two or all three of the AAV capsid protein(s). The methods of the invention based on in vivo screening address short-comings of prior cell culture based systems which are unable to simultaneously mimic in vivo conditions (e.g., the tight endothelial liming, differentiated skeletal muscle cells, the effects of the liver on vector biodistribution, etc.).

As one illustrative example, the inventors have practiced the methods of the invention to identify in vivo AAV capsid mutants having a desired tropism profile such as inefficient tropism for liver and/or efficient tropism for skeletal muscle (e.g., tongue muscle), diaphragm muscle and/or cardiac muscle.

The present invention is explained in greater detail below. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. In addition, numerous variations and additions to the various embodiments suggested herein will be apparent to those skilled in the art in light of the instant disclosure which do not depart from the instant invention. Hence, the following specification is intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

Except as otherwise indicated, standard methods known to those skilled in the art may be used for production of recombinant and synthetic polypeptides, antibodies or antigen-binding fragments thereof, manipulation of nucleic acid sequences, production of transformed cells, the construction of rAAV constructs, modified capsid proteins, packaging vectors expressing the AAV rep and/or cap sequences, and transiently and stably transfected packaging cells. Such techniques are known to those skilled in the art. See, e.g., SAMBROOK et al., MOLECULAR CLONING: A LABORATORY MANUAL 2nd Ed. (Cold Spring Harbor, N.Y., 1989); F. M. AUSUBEL et al. CURRENT PROTOCOLS IN MOLECULAR BIOLOGY (Green Publishing Associates, Inc. and John Wiley & Sons, Inc., New York).

All publications, patent applications, patents, nucleotide sequences, amino acid sequences and other references mentioned herein are incorporated by reference in their entirety.

I. DEFINITIONS

The designation of all amino acid positions in the AAV capsid subunits in the description of the invention and the appended claims is with respect to VP1 capsid subunit numbering.

As used in the description of the invention and the appended claims, the singular forms "a," "an" and "the" are intended to include the plural forms as well, unless the context clearly indicates otherwise.

As used herein, "and/or" refers to and encompasses any and all possible combinations of one or more of the associated listed items, as well as the lack of combinations when interpreted in the alternative ("or").

Moreover, the present invention also contemplates that in some embodiments of the invention, any feature or combination of features set forth herein can be excluded or omitted.

Furthermore, the term "about," as used herein when referring to a measurable value such as an amount of a compound or agent of this invention, dose, time, temperature, and the like, is meant to encompass variations of ±20%, ±10%, ±5%, ±1%, ±0.5%, or even ±0.1% of the specified amount.

The term "consisting essentially of" as used herein in connection with a nucleic acid, protein or capsid structure means that the nucleic acid, protein or capsid structure does not contain any element other than the recited element(s) that significantly alters (e.g., more than about 1%, 5% or 10%) the function of interest of the nucleic acid, protein or capsid structure, e.g., tropism profile or neutralization profile of the protein or capsid or a protein or capsid encoded by the nucleic acid.

The term "adeno-associated virus" (AAV) in the context of the present invention includes without limitation AAV type 1, AAV type 2, AAV type 3 (including types 3A and 3B), AAV type 4, AAV type 5, AAV type 6, AAV type 7, AAV type 8, AAV type 9, AAV type 10, AAV type 11, avian AAV, bovine AAV, canine AAV, equine AAV, and ovine AAV and any other AAV now known or later discovered. See, e.g., BERNARD N. FIELDS et al., VIROLOGY, volume 2, chapter 69 (4th ed., Lippincott-Raven Publishers). A number of additional AAV serotypes and clades have been identified (see, e.g., Gao et al., (2004) *J. Virology* 78:6381-6388 and Table 1), which are also encompassed by the term "AAV."

The genomic sequences of various AAV and autonomous parvoviruses, as well as the sequences of the ITRs, Rep proteins, and capsid subunits are known in the art. Such sequences may be found in the literature or in public databases such as the GenBank® database. See, e.g., GenBank® Accession Numbers NC 002077, NC 001401, NC 001729, NC 001863, NC 001829, NC 001862, NC 000883, NC 001701, NC 001510, AF063497, U89790, AF043303, AF028705, AF028704, J02275, J01901, J02275, X01457, AF288061, AH009962, AY028226, AY028223, NC 001358, NC 001540, AF513851, AF513852, AY530579, AY631965, AY631966; the disclosures of which are incorporated herein in their entirety. See also, e.g., Srivistava et al., (1983) *J. Virology* 45:555; Chiorini et al., (1998) *J. Virology* 71:6823; Chiorini et al., (1999) *J. Virology* 73:1309; Bantel-Schaal et al., (1999) *J. Virology* 73:939; Xiao et al., (1999) *J. Virology* 73:3994; Muramatsu et al., (1996) *Virology* 221:208; Shade et al., (1986) *J. Virol.* 58:921; Gao et al., (2002) *Proc. Nat. Acad. Sci. USA* 99:11854; international patent publications WO 00/28061, WO 99/61601, WO 98/11244; U.S. Pat. No. 6,156,303; the disclosures of which are incorporated herein in their entirety. See also Table 1. An early description of the AAV1, AAV2 and AAV3 terminal repeat sequences is provided by Xiao, X., (1996), "Characterization of

TABLE 1

| Complete Genomes | GenBank Accession Number |
|---|---|
| Adeno-associated virus 1 | NC_002077, AF063497 |
| Adeno-associated virus 2 | NC_001401 |
| Adeno-associated virus 3 | NC_001729 |
| Adeno-associated virus 3B | NC_001863 |
| Adeno-associated virus 4 | NC_001829 |
| Adeno-associated virus 5 | Y18065, AF085716 |
| Adeno-associated virus 6 | NC_001862 |
| Avian AAV ATCC VR-865 | AY186198, AY629583, NC_004828 |
| Avian AAV strain DA-1 | NC_006263, AY629583 |
| Bovine AAV | NC_005889, AY388617 |
| Clade A | |
| AAV1 | NC_002077, AF063497 |
| AAV6 | NC_001862 |
| Hu.48 | AY530611 |
| Hu 43 | AY530606 |
| Hu 44 | AY530607 |
| Hu 46 | AY530609 |
| Clade B | |
| Hu. 19 | AY530584 |
| Hu. 20 | AY530586 |
| Hu 23 | AY530589 |
| Hu22 | AY530588 |
| Hu24 | AY530590 |
| Hu21 | AY530587 |
| Hu27 | AY530592 |
| Hu28 | AY530593 |
| Hu 29 | AY530594 |
| Hu63 | AY530624 |
| Hu64 | AY530625 |
| Hu13 | AY530578 |
| Hu56 | AY530618 |
| Hu57 | AY530619 |
| Hu49 | AY530612 |
| Hu58 | AY530620 |
| Hu34 | AY530598 |
| Hu35 | AY530599 |
| AAV2 | NC_001401 |
| Hu45 | AY530608 |
| Hu47 | AY530610 |
| Hu51 | AY530613 |
| Hu52 | AY530614 |
| Hu T41 | AY695378 |
| Hu S17 | AY695376 |
| Hu T88 | AY695375 |
| Hu T71 | AY695374 |
| Hu T70 | AY695373 |
| Hu T40 | AY695372 |
| Hu T32 | AY695371 |
| Hu T17 | AY695370 |
| Hu LG15 | AY695377 |
| Clade C | |
| Hu9 | AY530629 |
| Hu10 | AY530576 |
| Hu11 | AY530577 |
| Hu53 | AY530615 |
| Hu55 | AY530617 |
| Hu54 | AY530616 |
| Hu7 | AY530628 |
| Hu18 | AY530583 |
| Hu15 | AY530580 |
| Hu16 | AY530581 |
| Hu25 | AY530591 |
| Hu60 | AY530622 |
| Ch5 | AY243021 |
| Hu3 | AY530595 |
| Hu1 | AY530575 |
| Hu4 | AY530602 |
| Hu2 | AY530585 |
| Hu61 | AY530623 |

TABLE 1-continued

| Complete Genomes | GenBank Accession Number |
| --- | --- |
| Clade D | |
| Rh62 | AY530573 |
| Rh48 | AY530561 |
| Rh54 | AY530567 |
| Rh55 | AY530568 |
| Cy2 | AY243020 |
| AAV7 | AF513851 |
| Rh35 | AY243000 |
| Rh37 | AY242998 |
| Rh36 | AY242999 |
| Cy6 | AY243016 |
| Cy4 | AY243018 |
| Cy3 | AY243019 |
| Cy5 | AY243017 |
| Rh13 | AY243013 |
| Clade E | |
| Rh38 | AY530558 |
| Hu66 | AY530626 |
| Hu42 | AY530605 |
| Hu67 | AY530627 |
| Hu40 | AY530603 |
| Hu41 | AY530604 |
| Hu37 | AY530600 |
| Rh40 | AY530559 |
| Rh2 | AY243007 |
| Bb1 | AY243023 |
| Bb2 | AY243022 |
| Rh10 | AY243015 |
| Hu17 | AY530582 |
| Hu6 | AY530621 |
| Rh25 | AY530557 |
| Pi2 | AY530554 |
| Pi1 | AY530553 |
| Pi3 | AY530555 |
| Rh57 | AY530569 |
| Rh50 | AY530563 |
| Rh49 | AY530562 |
| Hu39 | AY530601 |
| Rh58 | AY530570 |
| Rh61 | AY530572 |
| Rh52 | AY530565 |
| Rh53 | AY530566 |
| Rh51 | AY530564 |
| Rh64 | AY530574 |
| Rh43 | AY530560 |
| AAV8 | AF513852 |
| Rh8 | AY242997 |
| Rh1 | AY530556 |
| Clade F | |
| Hu14 (AAV9) | AY530579 |
| Hu31 | AY530596 |
| Hu32 | AY530597 |
| Clonal Isolate | |
| AAV5 | Y18065, AF085716 |
| AAV 3 | NC_001729 |
| AAV 3B | NC_001863 |
| AAV4 | NC_001829 |
| Rh34 | AY243001 |
| Rh33 | AY243002 |
| Rh32 | AY243003 |

Adeno-associated virus (AAV) DNA replication and integration," Ph.D. Dissertation, University of Pittsburgh, Pittsburgh, Pa. (incorporated herein it its entirety).

A "mosaic" or "scrambled" AAV nucleic acid capsid coding sequence or AAV capsid protein is the result of scrambling or shuffling two or more different AAV capsid sequences to produce capsid nucleic acid sequences and amino acid sequences (i.e., AAV capsid proteins) that combine portions of two or more capsid sequences. A "mosaic" or "scrambled" AAV virion or particle comprises a scrambled AAV capsid protein.

The term "tropism" as used herein refers to preferential entry of the virus into certain cell or tissue type(s) and/or preferential interaction with the cell surface that facilitates entry into certain cell or tissue types, optionally and preferably followed by expression (e.g., transcription and, optionally, translation) of sequences carried by the viral genome in the cell, e.g., for a recombinant virus, expression of the heterologous nucleotide sequence(s). Those skilled in the art will appreciate that transcription of a heterologous nucleic acid sequence from the viral genome may not be initiated in the absence of trans-acting factors, e.g., for an inducible promoter or otherwise regulated nucleic acid sequence. In the case of a rAAV genome, gene expression from the viral genome may be from a stably integrated provirus and/or from a non-integrated episome, as well as any other form in which the virus nucleic acid may take within the cell.

The term "tropism profile" refers to the pattern of transduction of one or more target cells, tissues and/or organs. For example, some scrambled AAV capsids may display efficient transduction of skeletal muscle (e.g., tongue muscle), diaphragm muscle and/or cardiac muscle tissue. Conversely, some scrambled AAV capsids have only low level transduction of liver, gonads and/or germ cells. Representative examples of mosaic or scrambled AAV capsids have a tropism profile characterized by efficient transduction of skeletal muscle, diaphragm muscle and/or cardiac muscle with only low transduction of liver.

As used herein, "transduction" of a cell by a virus vector (e.g., an AAV vector) means entry of the vector into the cell and transfer of genetic material into the cell by the incorporation of nucleic acid into the virus vector and subsequent transfer into the cell via the virus vector.

As used herein, a "collection" or "plurality" of virus particles, vectors, capsids or capsid proteins means two or more unless the context indicates otherwise.

Unless indicated otherwise, "efficient transduction" or "efficient tropism," or similar terms, can be determined by reference to a suitable control (e.g., at least about 50%, 60%, 70%, 80%, 85%, 90%, 95% or more of the transduction or tropism, respectively, of the control). In particular embodiments, the virus vector efficiently transduces or has efficient tropism for skeletal muscle, cardiac muscle, diaphragm muscle, pancreas (including β-islet cells), spleen, the gastrointestinal tract (e.g., epithelium and/or smooth muscle), lung, joint cells, and/or kidney. Suitable controls will depend on a variety of factors including the desired tropism profile. For example, AAV8 and AAV9 are highly efficient in transducing skeletal muscle, cardiac muscle and diaphragm muscle, but have the disadvantage of also transducing liver with high efficiency. Thus, the invention can be practiced to identify scrambled AAV that demonstrate the efficient transduction of skeletal, cardiac and/or diaphragm muscle of AAV8 or AAV9, but with a much lower transduction efficiency for liver. Further, because the tropism profile of interest may reflect tropism toward multiple target tissues, it will be appreciated that a suitable scrambled AAV may represent some tradeoffs. To illustrate, a scrambled AAV of the invention may be less efficient than AAV8 or AAV9 in transducing skeletal muscle, cardiac muscle and/or diaphragm muscle, but because of low level transduction of liver, may nonetheless be very desirable.

Similarly, it can be determined if a virus "does not efficiently transduce" or "does not have efficient tropism" for a target tissue, or similar terms, by reference to a suitable control. In particular embodiments, the virus vector does not efficiently, transduce (i.e., has does not have efficient tropism) for liver, kidney, gonads and/or germ cells. In particular embodiments, undesirable transduction of tissue(s) (e.g., liver) is 20% or less, 10% or less, 5% or less, 1% or less, 0.1% or less of the level of transduction of the desired target tissue(s) (e.g., skeletal muscle, diaphragm muscle and/or cardiac muscle).

As used herein, the term "polypeptide" encompasses both peptides and proteins, unless indicated otherwise.

A "nucleic acid" or "nucleotide sequence" is a sequence of nucleotide bases, and may be RNA, DNA or DNA-RNA hybrid sequences (including both naturally occurring and non-naturally occurring nucleotide), but is preferably either single or double stranded DNA sequences.

As used herein, an "isolated" nucleic acid or nucleotide sequence (e.g., an "isolated DNA" or an "isolated RNA") means a nucleic acid or nucleotide sequence separated or substantially free from at least some of the other components of the naturally occurring organism or virus, for example, the cell or viral structural components or other polypeptides or nucleic acids commonly found associated with the nucleic acid or nucleotide sequence.

Likewise, an "isolated" polypeptide means a polypeptide that is separated or substantially free from at least some of the other components of the naturally occurring organism or virus, for example, the cell or viral structural components or other polypeptides or nucleic acids commonly found associated with the polypeptide.

By the term "treat," "treating" or "treatment of" (or grammatically equivalent terms) it is meant that the severity of the subject's condition is reduced or at least partially improved or ameliorated and/or that some alleviation, mitigation or decrease in at least one clinical symptom is achieved and/or there is a delay in the progression of the condition and/or prevention or delay of the onset of a disease or disorder. The term "treat," "treats," "treating," or "treatment of" and the like also include prophylactic treatment of the subject (e.g., to prevent the onset of infection or cancer or a disorder). As used herein, the term "prevent," "prevents," or "prevention" (and grammatical equivalents thereof) are not meant to imply complete abolition of disease and encompasses any type of prophylactic treatment that reduces the incidence of the condition, delays the onset and/or progression of the condition, and/or reduces the symptoms associated with the condition. Thus, unless the context indicates otherwise, the term "treat," "treating" or "treatment of" (or grammatically equivalent terms) refer to both prophylactic and therapeutic regimens.

An "effective" amount as used herein is an amount that is sufficient to provide some improvement or benefit to the subject. Alternatively stated, an "effective" amount is an amount that will provide some alleviation, mitigation, or decrease in at least one clinical symptom in the subject. Those skilled in the art will appreciate that the therapeutic effects need not be complete or curative, as long as some benefit is provided to the subject.

A "heterologous nucleotide sequence" or "heterologous nucleic acid" is typically a sequence that is not naturally occurring in the virus. Generally, the heterologous nucleic acid or nucleotide sequence comprises an open reading frame that encodes a polypeptide and/or a nontranslated RNA.

A "therapeutic polypeptide" can be a polypeptide that can alleviate or reduce symptoms that result from an absence or defect in a protein in a cell or subject. In addition, a "therapeutic polypeptide" can be a polypeptide that otherwise confers a benefit to a subject, e.g., anti-cancer effects or improvement in transplant survivability.

As used herein, the term "vector," "virus vector," "delivery vector" (and similar terms) generally refers to a virus particle that functions as a nucleic acid delivery vehicle, and which comprises the viral nucleic acid (i.e., the vector genome) packaged within the virion. Virus vectors according to the present invention comprise a scrambled AAV capsid according to the invention and can package an AAV or rAAV genome or any other nucleic acid including viral nucleic acids. Alternatively, in some contexts, the term "vector," "virus vector," "delivery vector" (and similar terms) may be used to refer to the vector genome (e.g., vDNA) in the absence of the virion and/or to a viral capsid that acts as a transporter to deliver molecules tethered to the capsid or packaged within the capsid.

A "recombinant AAV vector genome" or "rAAV genome" is an AAV genome (i.e., vDNA) that comprises at least one inverted terminal repeat (e.g., one, two or three inverted terminal repeats) and one or more heterologous nucleotide sequences. rAAV vectors generally retain the 145 base terminal repeat(s) (TR(s)) in cis to generate virus; however, modified AAV TRs and non-AAV TRs including partially or completely synthetic sequences can also serve this purpose. All other viral sequences are dispensable and may be supplied in trans (Muzyczka, (1992) *Curr. Topics Microbiol. Immunol.* 158:97). The rAAV vector optionally comprises two TRs (e.g., AAV TRs), which generally will be at the 5' and 3' ends of the heterologous nucleotide sequence(s), but need not be contiguous thereto. The TRs can be the same or different from each other. The vector genome can also contain a single ITR at its 3' or 5' end.

The term "terminal repeat" or "TR" includes any viral terminal repeat or synthetic sequence that forms a hairpin structure and functions as an inverted terminal repeat (i.e., mediates the desired functions such as replication, virus packaging, integration and/or provirus rescue, and the like). The TR can be an AAV TR or a non-AAV TR. For example, a non-AAV TR sequence such as those of other parvoviruses (e.g., canine parvovirus (CPV), mouse parvovirus (MVM), human parvovirus B-19) or the SV40 hairpin that serves as the origin of SV40 replication can be used as a TR, which can further be modified by truncation, substitution, deletion, insertion and/or addition. Further, the TR can be partially or completely synthetic, such as the "double-D sequence" as described in U.S. Pat. No. 5,478,745 to Samulski et al.

An "AAV terminal repeat" or "AAV TR" may be from any AAV, including but not limited to serotypes 1, 2, 3, 4, 5, 6, 7, 8, 9, 10 or 11 or any other AAV now known or later discovered (see, e.g., Table 1). An AAV terminal repeat need not have the native terminal repeat sequence (e.g., a native AAV TR sequence may be altered by insertion, deletion, truncation and/or missense mutations), as long as the terminal repeat mediates the desired functions, e.g., replication, virus packaging, integration, and/or provirus rescue, and the like.

The terms "rAAV particle" and "rAAV virion" are used interchangeably here. A "rAAV particle" or "rAAV virion" comprises a rAAV vector genome packaged within an AAV capsid.

The AAV capsid structure is described in more detail in BERNARD N. FIELDS et al., VIROLOGY, volume 2, chapters 69 & 70 (4th ed., Lippincott-Raven Publishers).

By "substantially retain" a property, it is meant that at least about 75%, 85%, 90%, 95%, 97%, 98%, 99% or 100% of the property (e.g., activity or other measurable characteristic) is retained.

II. SCRAMBLED AAV CAPSIDS IDENTIFIED BY DIRECTED EVOLUTION AND IN VIVO PANNING

The inventors have identified "scrambled" or "mosaic" AAV capsid structures having characteristics of interest, e.g., tropism profile and/or neutralization profile. In particular embodiments, the scrambled capsid demonstrates inefficient transduction of liver and/or efficient transduction of skeletal muscle, diaphragm muscle and/or cardiac muscle.

Thus, in some embodiments, the invention provides scrambled AAV capsids comprising, consisting of or consisting essentially of AAV capsid proteins having the amino acid sequences shown in FIGS. 3C, 3F, 3I, 3L, 3O, 3R, 3U, 3S, 3AA, 3DD, 3GG, 3JJ, 3MM, 3PP, 3SS, 3VV, 3YY, 3BBB, 3EEE, 6B, 6D, 6F, 6H, 6J, 6L, 6N, 6P, 6R, 6T, 6V, 6X, 6Z, 6BB, 6DD, 6FF, 6HH, 6JJ, 6LL, 6NN, 6PP, 6RR, 6TT, 6VV, 6XX, 6ZZ, 6BBB, 6DDD, 6FFF, 6HHH, 6JJJ, 6LLL, 6NNN, 6PPP, 6RRR, 6TTT, 6VVV, 6XXX, 6ZZZ, 6BBBB, 6DDDD, 6FFFF, 6HHHH, 6JJJJ, 6LLLL, 6NNNN, 6PPPP, 6RRRR, 6TTTT and/or 6VVVV and viruses comprising the scrambled AAV capsids. These figures show the VP1 capsid protein sequences. Those skilled in the art will understand that the AAV capsid generally contains the smaller VP2 and VP3 capsid proteins as well. Due to the overlap of the coding sequences for the AAV capsid proteins, the nucleic acid coding sequences and amino acid sequences of the VP2 and VP3 capsid proteins will be apparent from the VP1 sequences shown in FIGS. 3A-3EEE and 6A-6VVVV.

In particular embodiments, the scrambled capsid protein can comprise, consist of, or consist essentially of the amino acid sequence of FIG. 3C (M41); the amino acid sequence of FIG. 3F (M17); the amino acid sequence of FIG. 3I (M22); the amino acid sequence of FIG. 3L (M35); the amino acid sequence of FIG. 3O (M42); the amino acid sequence of FIG. 3R (M62); the amino acid sequence of FIG. 3U (M67); the amino acid sequence of FIG. 3X (M125); the amino acid sequence of FIG. 3AA (M148); the amino acid sequence of FIG. 3DD (M151); the amino acid sequence of FIG. 3GG (H18); the amino acid sequence of FIG. 3JJ (H34); the amino acid sequence of FIG. 3MM (H39); the amino acid sequence of FIG. 3PP (H40); the amino acid sequence of FIG. 3SS (H43); the amino acid sequence of FIG. 3VV (H50); the amino acid sequence of FIG. 3YY (H53); the amino acid sequence of FIG. 3BBB (H66); the amino acid sequence of FIG. 3EEE (H109); the amino acid sequence of FIG. 6B (HH1); the amino acid sequence of FIG. 6D (HH15); the amino acid sequence of FIG. 6F (HH19); the amino acid sequence of FIG. 6H (HH27); the amino acid sequence of FIG. 6J (HH35); the amino acid sequence of FIG. 6L (HH41); the amino acid sequence of FIG. 6N(HH45); the amino acid sequence of FIG. 6P (HH53); the amino acid sequence of FIG. 6R (HH67); the amino acid sequence of FIG. 6T (HH68); the amino acid sequence of FIG. 6V (HH75); the amino acid sequence of FIG. 6X (HH87); the amino acid sequence of FIG. 6Z (HH64); the amino acid sequence of FIG. 6BB (MH4); the amino acid sequence of FIG. 6DD (MH18); the amino acid sequence of FIG. 6FF (MH21); the amino acid sequence of FIG. 6HH (MH31); the amino acid sequence of FIG. 6JJ (MH39); the amino acid sequence of FIG. 6LL (MHY43); the amino acid sequence of FIG. 6NN (MH47); the amino acid sequence of FIG. 6PP (MH58); the amino acid sequence of FIG. 6RR (MH63); the amino acid sequence of FIG. 6TT (MH71); the amino acid sequence of FIG. 6VV (MH74); the amino acid sequence of FIG. 6XX (MH78); the amino acid sequence of FIG. 6ZZ (MH82); the amino acid sequence of FIG. 6BBB (MH90); the amino acid sequence of FIG. 6DDD (MH94); the amino acid sequence of FIG. 6FFF (MH95); the amino acid sequence of FIG. 6HHH (MH107); the amino acid sequence of FIG. 6JJJ (MH113); the amino acid sequence of FIG. 6LLL (MM4); the amino acid sequence of FIG. 6NNN (MM7); the amino acid sequence of FIG. 6PPP (MM19); the amino acid sequence of FIG. 6RRR (MM35); the amino acid sequence of FIG. 6TTT (MM44); the amino acid sequence of FIG. 6VVV (MM55); the amino acid sequence of FIG. 6XXX (MM65); the amino acid sequence of FIG. 6ZZZ (MM68); the amino acid sequence of 6BBBB (MM84); the amino acid sequence of FIG. 6DDDD (MM107); the amino acid sequence of FIG. 6FFFF (MM112); the amino acid sequence of FIG. 6HHHH (MM115); the amino acid sequence of FIG. 6JJJJ (MM120); the amino acid sequence of FIG. 6LLLL (MM123); the amino acid sequence of FIG. 6NNNN (MM136); the amino acid sequence of FIG. 6PPPP (MM138); the amino acid sequence of FIG. 6RRRR (MM141); the amino acid sequence of FIG. 6TTTT (MM144), or the amino acid sequence of FIG. 6VVVV (MM153).

Further, in non-limiting embodiments, the scrambled AAV capsids and capsid proteins of the invention can be encoded by a nucleic acid comprising, consisting of, or consisting essentially of the nucleotide sequence of FIG. 3E (M17); the nucleotide sequence of FIG. 3H (M22); the nucleotide sequence of FIG. 3K (M35); the nucleotide sequence of FIG. 3B (M41); the nucleotide sequence of FIG. 3N (M42); the nucleotide sequence of FIG. 3Q (M62); the nucleotide sequence of FIG. 3T (M67); the nucleotide sequence of FIG. 3W (M125); the nucleotide sequence of FIG. 3Z (M148); the nucleotide sequence of FIG. 3CC (M151); the nucleotide sequence of FIG. 3FF (H18); the nucleotide sequence of FIG. 3II (H34); the nucleotide sequence of FIG. 3LL (H39); the nucleotide sequence of FIG. 3OO (H40); the nucleotide sequence of FIG. 3RR (H43); the nucleotide sequence of FIG. 3UU (H50); the nucleotide sequence of FIG. 3XX (H53); the nucleotide sequence of FIG. 3AAA (H66); the nucleotide sequence of FIG. 3DDD (H109); the nucleotide sequence of FIG. 6A (HH1); the nucleotide sequence of FIG. 6C (HH15); the nucleotide sequence of FIG. 6E (HH19); the nucleotide sequence of FIG. 6G (HH27); the nucleotide sequence of FIG. 6I (HH35); the nucleotide sequence of FIG. 6K (HH41); the nucleotide sequence of FIG. 6M (HH45); the nucleotide sequence of FIG. 6O (HH53); the nucleotide sequence of FIG. 6Q (HH67); the nucleotide sequence of FIG. 6S (HH68); the nucleotide sequence of FIG. 6U (HH75); the nucleotide sequence of FIG. 6W (HH87); the nucleotide sequence of FIG. 6Y (HH64); the nucleotide sequence of FIG. 6AA (MH4); the nucleotide sequence of FIG. 6CC (MH18); the nucleotide sequence of FIG. 6EE (MH21); the nucleotide sequence of FIG. 6GG (MH31); the nucleotide sequence of FIG. 6II (MH39); the nucleotide sequence of FIG. 6KK (MHY43); the nucleotide sequence of FIG. 6MM (MH47); the nucleotide sequence of FIG. 6OO (MH58); the nucleotide sequence of FIG. 6QQ (MH63); the nucleotide sequence of FIG. 6SS (MH71); the nucleotide sequence of FIG. 6UU (MH74); the nucleotide sequence of FIG. 6WW (MH78); the nucleotide sequence of FIG. 6YY (MH82); the nucleotide sequence of FIG. 6AAA (MH90); the nucleotide sequence of FIG. 6CCC (MH94); the nucleotide sequence of FIG. 6EEE (MH95); the nucleotide sequence of FIG. 6GGG (MH107); the nucleotide sequence of FIG. 6III (MH113); the nucleotide sequence of FIG. 6KKK (MM4); the nucleotide sequence of FIG. 6MMM (MM7); the nucleotide sequence of FIG. 6OOO (MM19); the nucleotide sequence of FIG. 6QQQ (MM35); the nucleotide sequence of FIG. 6SSS (MM44); the nucleotide sequence of FIG. 6OOO (MM55); the nucleotide sequence of FIG. 6WWW (MM65); the nucleotide sequence of FIG. 6YYY (MM68); the nucleotide sequence of 6AAAA (MM84); the nucleotide sequence of FIG. 6CCCC (MM107); the nucleotide sequence of FIG. 6EEEE (MM112); the nucleotide sequence of FIG. 6GGGG (MM115); the nucleotide sequence of FIG. 6IIII (MM120); the nucleotide sequence of FIG. 6KKKK (MM123); the nucleotide sequence of FIG. 6MMMM (MM136); the nucleotide sequence of FIG. 6OOOO (MM138); the nucleotide sequence of FIG. 6QQQQ (MM141); the nucleotide sequence of FIG. 6SSSS (MM144), or the nucleotide sequence of FIG. 6UUUU (MM153); or a nucleotide sequence that encodes an AAV capsid or capsid protein encoded by the nucleotide sequence of any of the foregoing but that differs from the nucleotide sequences of the foregoing due to the degeneracy of the genetic code.

The designation of all amino acid positions in the description of the invention and the appended claims is with respect to VP1 numbering. It will be understood by those skilled in the art that due to the overlap in the AAV capsid coding sequences the modifications described herein can also result in modifications in the VP2 and/or VP3 capsid subunits.

The invention also provides scrambled AAV capsid proteins and scrambled capsids comprising, consisting of, or consisting essentially of the same, wherein the capsid protein comprises, consists of, or consists essentially of an amino acid sequence as shown in FIGS. 3C, 3F, 3I, 3L, 3O, 3R, 3U, 3X, 3AA, 3DD, 3GG, 3JJ, 3MM, 3PP, 3SS, 3VV, 3YY, 3BBB, 3EEE, 6B, 6D, 6F, 6H, 6J, 6L, 6N, 6P, 6R, 6T, 6V, 6X, 6Z, 6BB, 6DD, 6FF, 6HH, 6JJ, 6LL, 6NN, 6PP, 6RR, 6TT, 6VV, 6XX, 6ZZ, 6BBB, 6DDD, 6FFF, 6HHH, 6JJJ, 6LLL, 6NNN, 6PPP, 6RRR, 6TTT, 6VVV, 6XXX, 6ZZZ, 6BBBB, 6DDDD, 6FFFF, 6HHHH, 6JJJJ, 6LLLL, 6NNNN, 6PPPP, 6RRRR, 6TTTT and/or 6VVVV (and described above), wherein 1, 2 or fewer, 3 or fewer, 4 or fewer, 5 or fewer, 6 or fewer, 7 or fewer, 8 or fewer, 9 or fewer, 10 or fewer, 12 or fewer, 15 or fewer, 20 or fewer, 25 or fewer, 30 or fewer, 40 or fewer, or 50 or fewer of the amino acids within the capsid protein coding sequence shown in FIGS. 3C, 3F, 3I, 3L, 3O, 3R, 3U, 3X, 3AA, 3DD, 3GG, 3JJ, 3MM, 3PP, 3SS, 3W, 3YY, 3BBB, 3EEE, 6B, 6D, 6F, 6H, 6J, 6L, 6N, 6P, 6R, 6T, 6V, 6X, 6Z, 6BB, 6DD, 6FF, 6HH, 6JJ, 6LL, 6NN, 6PP, 6RR, 6TT, 6VV, 6XX, 6ZZ, 6BBB, 6DDD, 6FFF, 6HHH, 6JJJ, 6LLL, 6NNN, 6PPP, 6RRR, 6TTT, 6VVV, 6XXX, 6ZZZ, 6BBBB, 6DDDD, 6FFFF, 6HHHH, 6JJJJ, 6LLLL, 6NNNN, 6PPPP, 6RRRR, 6TTTT and/or 6VVVV are substituted by another amino acid (naturally occurring, modified and/or synthetic), optionally a conservative amino acid substitution, and/or are deleted and/or there are insertions (including N-terminal and C-terminal extensions) of 1, 2 or fewer, 3 or fewer, 4 or fewer, 5 or fewer, 6 or fewer, 7 or fewer, 8 or fewer, 9 or fewer, 10 or fewer, 12 or fewer, 15 or fewer, 20 or fewer, 25 or fewer, 30 or fewer, 40 or fewer, or 50 or fewer amino acids or any combination of substitutions, deletions and/or insertions, wherein the substitutions, deletions and/or insertions do not unduly impair the structure and/or function of a virion (e.g., an AAV virion) comprising the variant capsid protein or capsid. For example, in representative embodiments of the invention, an AAV virion comprising the variant capsid protein substantially retains at least one property of a scrambled virion comprising a scrambled capsid protein as shown in FIGS. 3C, 3F, 3I, 3L, 3O, 3R, 3U, 3X, 3AA, 3DD, 3GG, 3JJ, 3MM, 3PP, 3SS, 3W, 3YY, 3BBB, 3EEE, 6B, 6D, 6F, 6H, 6J, 6L, 6N, 6P, 6R, 6T, 6V, 6X, 6Z, 6BB, 6DD, 6FF, 6HH, 6JJ, 6LL, 6NN, 6PP, 6RR, 6TT, 6VV, 6XX, 6ZZ, 6BBB, 6DDD, 6FFF, 6HHH, 6JJJ, 6LLL, 6NNN, 6PPP, 6RRR, 6TTT, 6VVV, 6XXX, 6ZZZ, 6BBBB, 6DDDD, 6FFFF, 6HHHH, 6JJJJ, 6LLLL, 6NNNN, 6PPPP, 6RRRR, 6TTTT and/or 6VVVV. For example, the virion comprising the variant capsid protein can substantially retain the tropism profile of a virion comprising the scrambled AAV capsid protein as shown in FIGS. 3C, 3F, 3I, 3L, 3O, 3R, 3U, 3X, 3AA, 3DD, 3GG, 3JJ, 3MM, 3PP, 3SS, 3W, 3YY, 3BBB, 3EEE, 6B, 6D, 6F, 6H, 6J, 6L, 6N, 6P, 6R, 6T, 6V, 6X, 6Z, 6BB, 6DD, 6FF, 6HH, 6JJ, 6LL, 6NN, 6PP, 6RR, 6TT, 6VV, 6XX, 6ZZ, 6BBB, 6DDD, 6FFF, 6HHH, 6JJJ, 6LLL, 6NNN, 6PPP, 6RRR, 6TTT, 6VVV, 6XXX, 6ZZZ, 6BBBB, 6DDDD, 6FFFF, 6HHHH, 6JJJJ, 6LLLL, 6NNNN, 6PPPP, 6RRRR, 6TTTT and/or 6VVVV (e.g., low efficiency transduction of liver and/or efficient transduction of skeletal muscle, cardiac muscle, diaphragm muscle and/or tongue muscle). Methods of evaluating biological properties such as virus transduction and/or neutralization by antibodies are well-known in the art (see, e.g., the Examples).

Conservative amino acid substitutions are known in the art. In particular embodiments, a conservative amino acid substitution includes substitutions within one or more of the following groups: glycine, alanine; valine, isoleucine, leucine; aspartic acid, glutamic acid; asparagine, glutamine; serine, threonine; lysine, arginine; and/or phenylalanine, tyrosine.

It will be apparent to those skilled in the art that the amino acid sequences of the scrambled AAV capsid proteins in FIGS. 3C, 3F, 3I, 3L, 3O, 3R, 3U, 3X, 3AA, 3DD, 3GG, 3JJ, 3MM, 3PP, 3SS, 3W, 3YY, 3BBB, 3EEE, 6B, 6D, 6F, 6H, 6J, 6L, 6N, 6P, 6R, 6T, 6V, 6X, 6Z, 6BB, 6DD, 6FF, 6HH, 6JJ, 6LL, 6NN, 6PP, 6RR, 6TT, 6VV, 6XX, 6ZZ, 6BBB, 6DDD, 6FFF, 6HHH, 6JJJ, 6LLL, 6NNN, 6PPP, 6RRR, 6TTT, 6VVV, 6XXX, 6ZZZ, 6BBBB, 6DDDD, 6FFFF, 6HHHH, 6JJJJ, 6LLLL, 6NNNN, 6PPPP, 6RRRR, 6TTTT and/or 6VVVV can further be modified to incorporate other modifications as known in the art to impart desired properties, for example, R484E and R585E mutations to the AAV2 capsid sequence have been described that resulted in improved cardiac transduction by AAV vector (Muller et al., (2006) *Cardiovascular Research* 70:70-78). As further nonlimiting possibilities, the capsid protein can be modified to incorporate targeting sequences (e.g., RGD) or sequences that facilitate purification and/or detection. For example, the capsid protein can be fused to all or a portion of glutathione-S-transferase, maltose-binding protein, a heparin/heparan sulfate binding domain, poly-His, a ligand, and/or a reporter protein (e.g., Green Fluorescent Protein, β-glucuronidase, β-galactosidase, luciferase, etc.), an immunoglobulin Fc fragment, a single-chain antibody, hemagglutinin, c-myc, FLAG epitope, and the like to form a fusion protein. Methods of inserting targeting peptides into the AAV capsid are known in the art (see, e.g., international patent publication WO 00/28004; Nicklin et al., (2001) *Molecular Therapy* 474-181; White et al., (2004) *Circulation* 109:513-319; Muller et al., (2003) *Nature Biotech*. 21:1040-1046.

The viruses of the invention can further comprise a duplexed viral genome as described in international patent publication WO 01/92551 and U.S. Pat. No. 7,465,583.

The invention also provides AAV capsids comprising the scrambled AAV capsid proteins of the invention and virus particles (i.e., virions) comprising the same, wherein the virus particle packages (i.e., encapsidates) a vector genome, optionally an AAV vector genome. In particular embodiments, the invention provides an AAV particle comprising an AAV capsid comprising an AAV capsid protein of the invention, wherein the AAV capsid packages an AAV vector genome. The invention also provides an AAV particle comprising an AAV capsid or AAV capsid protein encoded by the scrambled nucleic acid capsid coding sequences of the invention.

In particular embodiments, the virion is a recombinant vector comprising a heterologous nucleic acid of interest, e.g., for delivery to a cell. Thus, the present invention is useful for the delivery of nucleic acids to cells in vitro, ex vivo, and in vivo. In representative embodiments, the recombinant vector of the invention can be advantageously employed to deliver or transfer nucleic acids to animal (e.g., mammalian) cells.

Any heterologous nucleotide sequence(s) may be delivered by a virus vector of the present invention. Nucleic acids of interest include nucleic acids encoding polypeptides, optionally therapeutic (e.g., for medical or veterinary uses) and/or immunogenic (e.g., for vaccines) polypeptides.

Therapeutic polypeptides include, but are not limited to, cystic fibrosis transmembrane regulator protein (CFTR), dystrophin (including the protein product of dystrophin minigenes or micro-genes, see, e.g, Vincent et al., (1993) *Nature Genetics* 5:130; U.S. Patent Publication No. 2003017131; Wang et al., (2000) *Proc Natl Acad Sci USA.* 97:13714-9 [mini-dystrophin]; Harper et al., (2002) *Nat. Med.* 8:253-61 [micro-dystrophin]); mini-agrin, a laminin-α2, a sarcoglycan (α, β, γ or δ), Fukutin-related protein, myostatin pro-peptide, follistatin, dominant negative myostatin, an angiogenic factor (e.g., VEGF, angiopoietin-1 or 2), an anti-apoptotic factor (e.g., heme-oxygenase-1, TGF-β, inhibitors of pro-apoptotic signals such as caspases, proteases, kinases, death receptors [e.g., CD-095], modulators of cytochrome C release, inhibitors of mitochondrial pore opening and swelling); activin type II soluble receptor, anti-inflammatory polypeptides such as the Ikappa B dominant mutant, sarcospan, utrophin, mini-utrophin, antibodies or antibody fragments against myostatin or myostatin propeptide, cell cycle modulators, Rho kinase modulators such as Cethrin, which is a modified bacterial C3 exoenzyme [available from BioAxone Therapeutics, Inc., Saint-Lauren, Quebec, Canada], BCL-xL, BCL2, XIAP, FLICEc-s, dominant-negative caspase-8, dominant negative caspase-9, SPI-6 (see, e.g., U.S. Patent Application No. 20070026076), transcriptional factor PGC-α1, Pinch gene, ILK gene and thymosin β4 gene), clotting factors (e.g., Factor VIII, Factor IX, Factor X, etc.), erythropoietin, angiostatin, endostatin, catalase, tyrosine hydroxylase, an intracellular and/or extracellular superoxide dismutase, leptin, the LDL receptor, neprilysin, lipoprotein lipase, ornithine transcarbamylase, β-globin, α-globin, spectrin, $\alpha_1$-antitrypsin, adenosine deaminase, hypoxanthine guanine phosphoribosyl transferase, β-glucocerebrosidase, sphingomyelinase, lysosomal hexosaminidase A, branched-chain keto acid dehydrogenase, RP65 protein, a cytokine (e.g., α-interferon, βinterferon, interferon-γ, interleukins-1 through -14, granulocyte-macrophage colony stimulating factor, lymphotoxin, and the like), peptide growth factors, neurotrophic factors and hormones (e.g., somatotropin, insulin, insulin-like growth factors including IGF-1 and IGF-2, GLP-1, platelet derived growth factor, epidermal growth factor, fibroblast growth factor, nerve growth factor, neurotrophic factor-3 and -4, brain-derived neurotrophic factor, glial derived growth factor, transforming growth factor-α and β, and the like), bone morphogenic proteins (including RANKL and VEGF), a lysosomal protein, a glutamate receptor, a lymphokine, soluble CD4, an Fc receptor, a T cell receptor, ApoE, ApoC, inhibitor 1 of protein phosphatase inhibitor 1 (I-1), phospholamban, serca2a, lysosomal acid α-glucosidase, α-galactosidase A, Barkct, β2-adrenergic receptor, β2-adrenergic receptor kinase (BARK), phosphoinositide-3 kinase (PI3 kinase), calsarcin, a receptor (e.g., the tumor necrosis growth factor-α soluble receptor), an anti-inflammatory factor such as IRAP, Pim-1, PGC-1α, SOD-1, SOD-2, ECF-SOD, kallikrein, thymosin-β4, hypoxia-inducible transcription factor [HIF], an angiogenic factor, S100A1, parvalbumin, adenylyl cyclase type 6, a molecule that effects G-protein coupled receptor kinase type 2 knockdown such as a truncated constitutively active bARKct; phospholamban inhibitory or dominant-negative molecules such as phospholamban S16E, a monoclonal antibody (including single chain monoclonal antibodies) or a suicide gene product (e.g., thymidine kinase, cytosine deaminase, diphtheria toxin, and tumor necrosis factors such as TNF-α), and any other polypeptide that has a therapeutic effect in a subject in need thereof.

Heterologous nucleotide sequences encoding polypeptides include those encoding reporter polypeptides (e.g., an enzyme). Reporter polypeptides are known in the art and include, but are not limited to, Green Fluorescent Protein, β-galactosidase, alkaline phosphatase, luciferase, and chloramphenicol acetyltransferase.

Alternatively, the heterologous nucleic acid may encode an antisense oligonucleotide, a ribozyme (e.g., as described in U.S. Pat. No. 5,877,022), RNAs that effect spliceosome-mediated trans-splicing (see, Puttaraju et al., (1999) *Nature Biotech.* 17:246; U.S. Pat. No. 6,013,487; U.S. Pat. No. 6,083,702), interfering RNAs (RNAi) including small interfering RNAs (siRNA) that mediate gene silencing (see, Sharp et al., (2000) *Science* 287:2431), microRNA, or other non-translated "functional" RNAs, such as "guide" RNAs (Gorman et al., (1998) *Proc. Nat. Acad. Sci. USA* 95:4929; U.S. Pat. No. 5,869,248 to Yuan et al.), and the like. Exemplary untranslated RNAs include RNAi or antisense RNA against the multiple drug resistance (MDR) gene product (e.g., to treat tumors and/or for administration to the heart to prevent damage by chemotherapy), RNAi or antisense RNA against myostatin (Duchenne or Becker muscular dystrophy), RNAi or antisense RNA against VEGF or a tumor immunogen including but not limited to those tumor immunogens specifically described herein (to treat tumors), RNAi or antisense oligonucleotides targeting mutated dystrophins (Duchenne or Becker muscular dystrophy), RNAi or antisense RNA against the hepatitis B surface antigen gene (to prevent and/or treat hepatitis B infection), RNAi or antisense RNA against the HIV tat and/or rev genes (to prevent and/or treat HIV) and/or RNAi or antisense RNA against any other immunogen from a pathogen (to protect a subject from the pathogen) or a defective gene product (to prevent or treat disease). RNAi or anti-sense RNA against the targets described above or any other target can also be employed as a research reagent.

As is known in the art, anti-sense nucleic acids (e.g., DNA or RNA) and inhibitory RNA (e.g., microRNA and RNAi such as siRNA or shRNA) sequences can be used to induce "exon skipping" in patients with muscular dystrophy arising from defects in the dystrophin gene. Thus, the heterologous nucleic acid can encode an antisense nucleic acid or inhibitory RNA that induces appropriate exon skipping. Those skilled in the art will appreciate that the particular approach to exon skipping depends upon the nature of the underlying defect in the dystrophin gene, and numerous such strategies are known in the art. Exemplary antisense nucleic acids and inhibitory RNA sequences target the upstream branch point and/or downstream donor splice site and/or internal splicing enhancer sequence of one or more of the dystrophin exons (e.g., exons 19 or 23). For example, in particular embodiments, the heterologous nucleic acid encodes an antisense nucleic acid or inhibitory RNA directed against the upstream branch point and downstream splice donor site of exon 19 or 23 of the dystrophin gene. Such sequences can be incorporated into an AAV vector delivering a modified U7 snRNA and the antisense nucleic acid or inhibitory RNA (see, e.g., Goyenvalle et al., (2004) *Science* 306:1796-1799). As another strategy, a modified U1 snRNA can be incorporated into an AAV vector along with siRNA, microRNA or antisense RNA complementary to the upstream and downstream splice sites of a dystrophin exon (e.g., exon 19 or 23) (see, e.g., Denti et al. (2006) *Proc. Nat. Acad. Sci.* 103:3758-3763). Further, antisense nucleic acids and inhibitory RNA can target the splicing enhancer sequences within exons 19, 43, 45 or 53 (see, e.g., U.S. Pat. No. 6,653,467; U.S. Pat. No. 6,727,355; and U.S. Pat. No. 6,653,466).

Ribozymes are RNA-protein complexes that cleave nucleic acids in a site-specific fashion. Ribozymes have specific catalytic domains that possess endonuclease activity (Kim et al., (1987) *Proc. Natl. Acad. Sci. USA* 84:8788; Gerlach et al., (1987) *Nature* 328:802; Forster and Symons, (1987) *Cell* 49:211). For example, a large number of ribozymes accelerate phosphoester transfer reactions with a high degree of specificity, often cleaving only one of several phosphoesters in an oligonucleotide substrate (Michel and Westhof, (1990) *J. Mol. Biol.* 216:585; Reinhold-Hurek and Shub, (1992) *Nature* 357:173). This specificity has been attributed to the requirement that the substrate bind via specific base-pairing interactions to the internal guide sequence ("IGS") of the ribozyme prior to chemical reaction.

Ribozyme catalysis has primarily been observed as part of sequence-specific cleavage/ligation reactions involving nucleic acids (Joyce, (1989) *Nature* 338:217). For example, U.S. Pat. No. 5,354,855 reports that certain ribozymes can act as endonucleases with a sequence specificity greater than that of known ribonucleases and approaching that of the DNA restriction enzymes. Thus, sequence-specific ribozyme-mediated inhibition of nucleic acid expression may be particularly suited to therapeutic applications (Scanlon et al., (1991) *Proc. Natl. Acad. Sci. USA* 88:10591; Sarver et al., (1990) *Science* 247:1222; Sioud et al., (1992) *J. Mol. Biol.* 223:831).

MicroRNAs (mir) are natural cellular RNA molecules that can regulate the expression of multiple genes by controlling the stability of the mRNA. Over-expression or diminution of a particular microRNA can be used to treat a dysfunction and has been shown to be effective in a number of disease states and animal models of disease (see, e.g., Couzin, (2008) *Science* 319:1782-4). The scrambled AAV can be used to deliver microRNA into cells, tissues and subjects for the treatment of genetic and acquired diseases, or to enhance functionality and promote growth of certain tissues. For example, mir-1, mir-133, mir-206 and/or mir-208 can be used to treat cardiac and skeletal muscle disease (see, e.g., Chen et al., (2006) *Genet.* 38:228-33; van Rooij et al., (2008) *Trends Genet.* 24:159-66). MicroRNA can also be used to modulate the immune system after gene delivery (Brown et al., (2007) *Blood* 110:4144-52.)

The term "antisense oligonucleotide" (including "antisense RNA") as used herein, refers to a nucleic acid that is complementary to and specifically hybridizes to a specified DNA or RNA sequence. Antisense oligonucleotides and nucleic acids that encode the same can be made in accordance with conventional techniques. See, e.g., U.S. Pat. No. 5,023, 243 to Tullis; U.S. Pat. No. 5,149,797 to Pederson et al.

Those skilled in the art will appreciate that it is not necessary that the antisense oligonucleotide be fully complementary to the target sequence as long as the degree of sequence similarity is sufficient for the antisense nucleotide sequence to specifically hybridize to its target (as defined above) and reduce production of the protein product (e.g., by at least about 30%, 40%, 50%, 60%, 70%, 80%, 90%, 95% or more).

To determine the specificity of hybridization, hybridization of such oligonucleotides to target sequences can be carried out under conditions of reduced stringency, medium stringency or even stringent conditions. Suitable conditions for achieving reduced, medium and stringent hybridization conditions are as described herein.

Alternatively stated, in particular embodiments, antisense oligonucleotides of the invention have at least about 60%, 70%, 80%, 90%, 95%, 97%, 98% or higher sequence similarity with the complement of the target sequence and reduce production of the protein product (as defined above). In some embodiments, the antisense sequence contains 1, 2, 3, 4, 5, 6, 7, 8, 9 or 10 mismatches as compared with the target sequence.

Methods of determining percent identity of nucleic acid sequences are described in more detail elsewhere herein.

The length of the antisense oligonucleotide is not critical as long as it specifically hybridizes to the intended target and reduces production of the protein product (as defined above) and can be determined in accordance with routine procedures. In general, the antisense oligonucleotide is at least about eight, ten or twelve or fifteen nucleotides in length and/or less than about 20, 30, 40, 50, 60, 70, 80, 100 or 150 nucleotides in length.

An antisense oligonucleotide can be constructed using chemical synthesis and enzymatic ligation reactions by procedures known in the art. For example, an antisense oligonucleotide can be chemically synthesized using naturally occurring nucleotides or various modified nucleotides designed to increase the biological stability of the molecules and/or to increase the physical stability of the duplex formed between the antisense and sense nucleotide sequences, e.g., phosphorothioate derivatives and acridine substituted nucleotides can be used.

Examples of modified nucleotides which can be used to generate the antisense oligonucleotide include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopenten-yladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine.

The antisense oligonucleotides can further include nucleotide sequences wherein at least one, or all, of the internucleotide bridging phosphate residues are modified phosphates, such as methyl phosphonates, methyl phosphonothioates, phosphoromorpholidates, phosphoropiperazidates and phosphoramidates. For example, every other one of the internucleotide bridging phosphate residues can be modified as described.

As another non-limiting example, one or all of the nucleotides in the oligonucleotide can contain a 2' loweralkyl moiety (e.g., $C_1$-$C_4$, linear or branched, saturated or unsaturated alkyl, such as methyl, ethyl, ethenyl, propyl, 1-propenyl, 2-propenyl, and isopropyl). For example, every other one of the nucleotides can be modified as described. See also, Furdon et al., (1989) *Nucleic Acids Res.* 17, 9193-9204; Agrawal et al., (1990) *Proc. Natl. Acad. Sci. USA* 87, 1401-1405; Baker et al., (1990) *Nucleic Acids Res.* 18, 3537-3543; Sproat et al., (1989) *Nucleic Acids Res.* 17, 3373-3386; Walder and Walder, (1988) *Proc. Natl. Acad. Sci. USA* 85, 5011-5015.

The antisense oligonucleotide can be chemically modified (e.g., at the 3' and/or 5' end) to be covalently conjugated to another molecule. To illustrate, the antisense oligonucleotide can be conjugated to a molecule that facilitates delivery to a cell of interest, enhances absorption by the nasal mucosa (e.g, by conjugation to a lipophilic moiety such as a fatty acid), provides a detectable marker, increases the bioavailability of the oligonucleotide, increases the stability of the oligonucleotide, improves the formulation or pharmacokinetic characteristics, and the like. Examples of conjugated molecules include but are not limited to cholesterol, lipids, polyamines, polyamides, polyesters, intercalators, reporter molecules, biotin, dyes, polyethylene glycol, human serum albumin, an enzyme, an antibody or antibody fragment, or a ligand for a cellular receptor.

Other modifications to nucleic acids to improve the stability, nuclease-resistance, bioavailability, formulation characteristics and/or pharmacokinetic properties are known in the art.

RNA interference (RNAi) is another useful approach for reducing production of a protein product (e.g., shRNA or siRNA). RNAi is a mechanism of post-transcriptional gene silencing in which double-stranded RNA (dsRNA) corresponding to a target sequence of interest is introduced into a cell or an organism, resulting in degradation of the corresponding mRNA. The mechanism by which RNAi achieves gene silencing has been reviewed in Sharp et al, (2001) *Genes Dev* 15: 485-490; and Hammond et al., (2001) *Nature Rev Gen* 2:110-119). The RNAi effect persists for multiple cell divisions before gene expression is regained. RNAi is therefore a powerful method for making targeted knockouts or "knockdowns" at the RNA level. RNAi has proven successful in human cells, including human embryonic kidney and HeLa cells (see, e.g., Elbashir et al., *Nature* (2001) 411:494-8).

Initial attempts to use RNAi in mammalian cells resulted in antiviral defense mechanisms involving PKR in response to the dsRNA molecules (see, e.g., Gil et al. (2000) *Apoptosis* 5:107). It has since been demonstrated that short synthetic dsRNA of about 21 nucleotides, known as "short interfering RNAs" (siRNA) can mediate silencing in mammalian cells without triggering the antiviral response (see, e.g., Elbashir et al., *Nature* (2001) 411:494-8; Caplen et al., (2001) *Proc. Nat. Acad. Sci.* 98:9742).

The RNAi molecule (including an siRNA molecule) can be a short hairpin RNA (shRNA; see Paddison et al., (2002), *PNAS USA* 99:1443-1448), which is believed to be processed in the cell by the action of the RNase III like enzyme Dicer into 20-25mer siRNA molecules. The shRNAs generally have a stem-loop structure in which two inverted repeat sequences are separated by a short spacer sequence that loops out. There have been reports of shRNAs with loops ranging from 3 to 23 nucleotides in length. The loop sequence is generally not critical. Exemplary loop sequences include the following motifs: AUG, CCC, UUCG, CCACC, CTCGAG, AAGCUU, CCACACC and UUCAAGAGA.

The RNAi can further comprise a circular molecule comprising sense and antisense regions with two loop regions on either side to form a "dumbbell" shaped structure upon dsRNA formation between the sense and antisense regions. This molecule can be processed in vitro or in vivo to release the dsRNA portion, e.g., a siRNA.

International patent publication WO 01/77350 describes a vector for bi-directional transcription to generate both sense and antisense transcripts of a heterologous sequence in a eukaryotic cell. This technique can be employed to produce RNAi for use according to the invention.

Shinagawa et al. (2003) *Genes & Dev.* 17:1340 reported a method of expressing long dsRNAs from a CMV promoter (a pol II promoter), which method is also applicable to tissue specific pol II promoters. Likewise, the approach of Xia et al., (2002) *Nature Biotech.* 20:1006, avoids poly(A) tailing and can be used in connection with tissue-specific promoters.

Methods of generating RNAi include chemical synthesis, in vitro transcription, digestion of long dsRNA by Dicer (in vitro or in vivo), expression in vivo from a delivery vector, and expression in vivo from a PCR-derived RNAi expression cassette (see, e.g., TechNotes 10(3) "Five Ways to Produce siRNAs," from Ambion, Inc., Austin Tex.; available at www.ambion.com).

Guidelines for designing siRNA molecules are available (see e.g., literature from Ambion, Inc., Austin Tex.; available at www.ambion.com). In particular embodiments, the siRNA sequence has about 30-50% G/C content. Further, long stretches of greater than four T or A residues are generally avoided if RNA polymerase III is used to transcribe the RNA. Online siRNA target finders are available, e.g., from Ambion, Inc. (www.ambion.com), through the Whitehead Institute of Biomedical Research (www.jura.wi.mit.edu) or from Dharmacon Research, Inc. (www.dharmacon.com/).

The antisense region of the RNAi molecule can be completely complementary to the target sequence, but need not be as long as it specifically hybridizes to the target sequence (as defined above) and reduces production of the protein product (e.g., by at least about 30%, 40%, 50%, 60%, 70%, 80%, 90%, 95% or more). In some embodiments, hybridization of such oligonucleotides to target sequences can be carried out under conditions of reduced stringency, medium stringency or even stringent conditions, as defined above.

In other embodiments, the antisense region of the RNAi has at least about 60%, 70%, 80%, 90%, 95%, 97%, 98% or higher sequence identity with the complement of the target sequence and reduces production of the protein product (e.g., by at least about 30%, 40%, 50%, 60%, 70%, 80%, 90%, 95% or more). In some embodiments, the antisense region contains 1, 2, 3, 4, 5, 6, 7, 8, 9 or 10 mismatches as compared with the target sequence. Mismatches are generally tolerated better at the ends of the dsRNA than in the center portion.

In particular embodiments, the RNAi is formed by intermolecular complexing between two separate sense and antisense molecules. The RNAi comprises a ds region formed by the intermolecular basepairing between the two separate strands. In other embodiments, the RNAi comprises a ds region formed by intramolecular basepairing within a single nucleic acid molecule comprising both sense and antisense regions, typically as an inverted repeat (e.g., a shRNA or other stem loop structure, or a circular RNAi molecule). The RNAi can further comprise a spacer region between the sense and antisense regions.

The RNAi molecule can contain modified sugars, nucleotides, backbone linkages and other modifications as described above for antisense oligonucleotides.

Generally, RNAi molecules are highly selective. If desired, those skilled in the art can readily eliminate candidate RNAi that are likely to interfere with expression of nucleic acids other than the target by searching relevant databases to identify RNAi sequences that do not have substantial sequence homology with other known sequences, for example, using BLAST (available at www.ncbi.nlm.nih.gov/BLAST).

Kits for the production of RNAi are commercially available, e.g., from New England Biolabs, Inc. and Ambion, Inc.

The recombinant virus vector may also comprise a heterologous nucleotide sequence that shares homology with and recombines with a locus on the host chromosome. This approach may be utilized to correct a genetic defect in the host cell.

The present invention also provides recombinant virus vectors that express an immunogenic polypeptide, e.g., for vaccination. The heterologous nucleic acid may encode any immunogen of interest known in the art including, but are not limited to, immunogens from human immunodeficiency virus, influenza virus, gag proteins, tumor antigens, cancer antigens, bacterial antigens, viral antigens, and the like. Alternatively, the immunogen can be presented in the virus capsid (e.g., incorporated therein) or tethered to the virus capsid (e.g., by covalent modification).

The use of parvoviruses as vaccines is known in the art (see, e.g., Miyamura et al., (1994) *Proc. Nat. Acad. Sci. USA* 91:8507; U.S. Pat. No. 5,916,563 to Young et al., U.S. Pat. No. 5,905,040 to Mazzara et al., U.S. Pat. No. 5,882,652, U.S. Pat. No. 5,863,541 to Samulski et al.; the disclosures of which are incorporated herein in their entireties by reference). The antigen may be presented in the virus capsid. Alternatively, the antigen may be expressed from a heterologous nucleic acid introduced into a recombinant vector genome.

An immunogenic polypeptide, or immunogen, may be any polypeptide suitable for protecting the subject against a disease, including but not limited to microbial, bacterial, protozoal, parasitic, fungal and viral diseases. For example, the immunogen may be an orthomyxovirus immunogen (e.g., an influenza virus immunogen, such as the influenza virus hemagglutinin (HA) surface protein or the influenza virus nucleoprotein gene, or an equine influenza virus immunogen), or a lentivirus immunogen (e.g., an equine infectious anemia virus immunogen, a Simian Immunodeficiency Virus (SIV) immunogen, or a Human Immunodeficiency Virus (HIV) immunogen, such as the HIV or SIV envelope GP160 protein, the HIV or SIV matrix/capsid proteins, and the HIV or SIV gag, pol and env genes products). The immunogen may also be an arenavirus immunogen (e.g., Lassa fever virus immunogen, such as the Lassa fever virus nucleocapsid protein gene and the Lassa fever envelope glycoprotein gene), a poxvirus immunogen (e.g., vaccinia, such as the vaccinia L1 or L8 genes), a flavivirus immunogen (e.g., a yellow fever virus immunogen or a Japanese encephalitis virus immunogen), a filovirus immunogen (e.g., an Ebola virus immunogen, or a Marburg virus immunogen, such as NP and GP genes), a bunyavirus immunogen (e.g., RVFV, CCHF, and SFS viruses), or a coronavirus immunogen (e.g., an infectious human coronavirus immunogen, such as the human coronavirus envelope glycoprotein gene, or a porcine transmissible gastroenteritis virus immunogen, or an avian infectious bronchitis virus immunogen, or a severe acute respiratory syndrome (SARS) immunogen such as a S [S1 or S2], M, E, or N protein or an immunogenic fragment thereof). The immunogen may further be a polio immunogen, herpes immunogen (e.g., CMV, EBV, HSV immunogens) mumps immunogen, measles immunogen, rubella immunogen, diphtheria toxin or other diptheria immunogen, pertussis antigen, hepatitis (e.g., hepatitis A, hepatitis B or hepatitis C) immunogen, or any other vaccine immunogen known in the art.

Alternatively, the immunogen may be any tumor or cancer cell antigen. Optionally, the tumor or cancer antigen is expressed on the surface of the cancer cell. Exemplary cancer and tumor cell antigens are described in S. A. Rosenberg, (1999) *Immunity* 10:281). Illustrative cancer and tumor antigens include, but are not limited to: BRCA1 gene product, BRCA2 gene product, gp100, tyrosinase, GAGE-1/2, BAGE, RAGE, NY-ESO-1, CDK-4, β-catenin, MUM-1, Caspase-8, KIAA0205, HPVE, SART-1, PRAME, p15, melanoma tumor antigens (Kawakami et al., (1994) *Proc. Natl. Acad. Sci. USA* 91:3515; Kawakami et al., (1994) *J. Exp. Med.,* 180:347; Kawakami et al., (1994) *Cancer Res.* 54:3124) including MART-1 (Coulie et al., (1991) *J. Exp. Med.* 180:35), gp100 (Wick et al., (1988) *J. Cutan. Pathol.* 4:201) and MAGE antigen (MAGE-1, MAGE-2 and MAGE-3) (Van der Bruggen et al., (1991) *Science,* 254:1643), CEA, TRP-1; TRP-2; P-15 and tyrosinase (Brichard et al., (1993) *J. Exp. Med.* 178:489); HER-2/neu gene product (U.S. Pat. No. 4,968,603); CA 125; HE4; LK26; FB5 (endosialin); TAG 72; AFP; CA19-9; NSE; DU-PAN-2; CA50; SPan-1; CA72-4; HCG; STN (sialyl Tn antigen); c-erbB-2 proteins; PSA; L-CanAg; estrogen receptor; milk fat globulin; p53 tumor suppressor protein (Levine, (1993) *Ann. Rev. Biochem.* 62:623); mucin antigens (international patent publication WO 90/05142); telomerases; nuclear matrix proteins; prostatic acid phosphatase; papilloma virus antigens; and antigens associated with the following cancers: melanomas, adenocarcinoma, thymoma, sarcoma, lung cancer, liver cancer, colorectal cancer, non-Hodgkin's lymphoma, Hodgkin's lymphoma, leukemias, uterine cancer, breast cancer, prostate cancer, ovarian cancer, cervical cancer, bladder cancer, kidney cancer, pancreatic cancer, brain cancer, kidney cancer, stomach cancer, esophageal cancer, head and neck cancer and others (see, e.g., Rosenberg, (1996) *Ann. Rev. Med.* 47:481-91).

Alternatively, the heterologous nucleotide sequence may encode any polypeptide that is desirably produced in a cell in vitro, ex vivo, or in vivo. For example, the virus vectors may be introduced into cultured cells and the expressed protein product isolated therefrom.

It will be understood by those skilled in the art that the heterologous nucleic acid(s) of interest may be operably associated with appropriate control sequences. For example, the heterologous nucleic acid may be operably associated with expression control elements, such as transcription/translation control signals, origins of replication, polyadenylation signals, internal ribosome entry sites (IRES), promoters, enhancers, and the like.

Those skilled in the art will further appreciate that a variety of promoter/enhancer elements may be used depending on the level and tissue-specific expression desired. The promoter/enhancer may be constitutive or inducible, depending on the pattern of expression desired. The promoter/enhancer may be native or foreign and can be a natural or a synthetic sequence. By foreign, it is intended that the transcriptional initiation region is not found in the wild-type host into which the transcriptional initiation region is introduced.

Promoter/enhancer elements can be native to the target cell or subject to be treated and/or native to the heterologous nucleic acid sequence. The promoter/enhancer element is generally chosen so that it will function in the target cell(s) of interest. In representative embodiments, the promoter/enhancer element is a mammalian promoter/enhancer element. The promoter/enhance element may be constitutive or inducible.

Inducible expression control elements are generally used in those applications in which it is desirable to provide regulation over expression of the heterologous nucleic acid sequence(s). Inducible promoters/enhancers elements for gene delivery can be tissue-specific or tissue-preferred promoter/enhancer elements, and include muscle specific or preferred (including cardiac, skeletal and/or smooth muscle), neural tissue specific or preferred (including brain-specific), eye (including retina-specific and cornea-specific), liver specific or preferred, bone marrow specific or preferred, pancreatic specific or preferred, spleen specific or preferred, and lung specific or preferred promoter/enhancer elements. Other inducible promoter/enhancer elements include hormone-inducible and metal-inducible elements. Exemplary inducible promoters/enhancer elements include, but are not limited to, a Tet on/off element, a RU486-inducible promoter, an ecdysone-inducible promoter, a rapamycin-inducible promoter, and a metallothionein promoter.

In embodiments wherein which the heterologous nucleic acid sequence(s) is transcribed and then translated in the target cells, specific initiation signals are generally employed for efficient translation of inserted protein coding sequences. These exogenous translational control sequences, which may include the ATG initiation codon and adjacent sequences, can be of a variety of origins, both natural and synthetic.

The invention also provides scrambled AAV particles comprising an AAV capsid and an AAV genome, wherein the AAV genome "corresponds to" (i.e., encodes) the AAV capsid. Also provided are collections or libraries of such scrambled AAV particles, wherein the collection or library comprises 2 or more, 10 or more, 50 or more, 100 or more, 1000 or more, $10^4$ or more, $10^5$ or more, or $10^6$ or more distinct sequences.

The present invention further encompasses "empty" capsid particles (i.e., in the absence of a vector genome) comprising, consisting of, or consisting essentially of the scrambled AAV capsid proteins of the invention. The scrambled AAV capsids of the invention can be used as "capsid vehicles," as has been described in U.S. Pat. No. 5,863,541. Molecules that can be covalently linked, bound to or packaged by the virus capsids and transferred into a cell include DNA, RNA, a lipid, a carbohydrate, a polypeptide, a small organic molecule, or combinations of the same. Further, molecules can be associated with (e.g., "tethered to") the outside of the virus capsid for transfer of the molecules into host target cells. In one embodiment of the invention the molecule is covalently linked (i.e., conjugated or chemically coupled) to the capsid proteins. Methods of covalently linking molecules are known by those skilled in the art.

The virus capsids of the invention also find use in raising antibodies against the novel capsid structures. As a further alternative, an exogenous amino acid sequence may be inserted into the virus capsid for antigen presentation to a cell, e.g., for administration to a subject to produce an immune response to the exogenous amino acid sequence.

The invention also provides nucleic acids (e.g., isolated nucleic acids) encoding the scrambled virus capsids and scrambled capsid proteins of the invention. Further provided are vectors comprising the nucleic acids, and cells (in vivo or in culture) comprising the nucleic acids and/or vectors of the invention. Such nucleic acids, vectors and cells can be used, for example, as reagents (e.g., helper constructs or packaging cells) for the production of virus vectors as described herein.

In exemplary embodiments, the invention provides nucleic acid sequences encoding the AAV capsids of FIGS. 3C, 3F, 3I, 3L, 3O, 3R, 3U, 3X, 3ZZ, 3DD, 3GG, 3JJ, 3MM, 3PP, 3SS, 3W, 3YY, 3BBB, 3EEE, 6B, 6D, 6F, 6H, 6J, 6L, 6N, 6P, 6R, 6T, 6V, 6X, 6Z, 6BB, 6DD, 6FF, 6HH, 6JJ, 6LL, 6NN, 6PP, 6RR, 6TT, 6VV, 6XX, 6ZZ, 6BBB, 6DDD, 6FFF, 6HHH, 6JJJ, 6LLL, 6NNN, 6PPP, 6RRR, 6TTT, 6VVV, 6XXX, 6ZZZ, 6BBBB, 6DDDD, 6FFFF, 6HHHH, 6JJJJ, 6LLLL, 6NNNN, 6PPPP, 6RRRR, 6TTTT and/or 6VVVV. Representative nucleic acids comprise, consist of, or consist essentially of the sequences of FIG. 3, i.e., the nucleotide sequence of FIG. 3E (M17); the nucleotide sequence of FIG. 3H (M22); the nucleotide sequence of FIG. 3K (M35); the nucleotide sequence of FIG. 3B (M41); the nucleotide sequence of FIG. 3N (M42); the nucleotide sequence of FIG. 3Q (M62); the nucleotide sequence of FIG. 3T (M67); the nucleotide sequence of FIG. 3W (M125); the nucleotide sequence of FIG. 3Z (M148); the nucleotide sequence of FIG. 3CC (M151); the nucleotide sequence of FIG. 3FF (H18); the nucleotide sequence of FIG. 3II (H34); the nucleotide sequence of FIG. 3LL (H39); the nucleotide sequence of FIG. 3OO (H40); the nucleotide sequence of FIG. 3RR (H43); the nucleotide sequence of FIG. 3UU (H50); the nucleotide sequence of FIG. 3XX (H53); the nucleotide sequence of FIG. 3AAA (H66); the nucleotide sequence of FIG. 3DDD (H109); the nucleotide sequence of FIG. 6A (HH1); the nucleotide sequence of FIG. 6C(HH15); the nucleotide sequence of FIG. 6E (HH19); the nucleotide sequence of FIG. 6G (HH27); the nucleotide sequence of FIG. 6I (HH35); the nucleotide sequence of FIG. 6K (HH41); the nucleotide sequence of FIG. 6M (HH45); the nucleotide sequence of FIG. 6O (HH53); the nucleotide sequence of FIG. 6Q (HH67); the nucleotide sequence of FIG. 6S (HH68); the nucleotide sequence of FIG. 6U (HH75); the nucleotide sequence of FIG. 6W (HH87); the nucleotide sequence of FIG. 6Y (HH64); the nucleotide sequence of FIG. 6AA (MH4); the nucleotide sequence of FIG. 6CC (MH18); the nucleotide sequence of FIG. 6EE (MH21); the nucleotide sequence of FIG. 6GG (MH31); the nucleotide sequence of FIG. 6II (MH39); the nucleotide sequence of FIG. 6KK (MHY43); the nucleotide sequence of FIG. 6MM (MH47); the nucleotide sequence of FIG. 6OO (MH58); the nucleotide sequence of FIG. 6QQ (MH63); the nucleotide sequence of FIG. 6SS (MH71); the nucleotide sequence of FIG. 6UU (MH74); the nucleotide sequence of FIG. 6WW (MH78); the nucleotide sequence of FIG. 6YY (MH82); the nucleotide sequence of FIG. 6AAA (MH90); the nucleotide sequence of FIG. 6CCC (MH94); the nucleotide sequence of FIG. 6EEE (MH95); the nucleotide sequence of FIG. 6GGG (MH107); the nucleotide sequence of FIG. 6III (MH113); the nucleotide sequence of FIG. 6KKK (MM4); the nucleotide sequence of FIG. 6MMM (MM7); the nucleotide sequence of FIG. 6OOO (MM19); the nucleotide sequence of FIG. 6QQQ (MM35); the nucleotide sequence of FIG. 6SSS (MM44); the nucleotide sequence of FIG. 6OOO (MM55); the nucleotide sequence of FIG. 6WWW (MM65); the nucleotide sequence of FIG. 6YYY (MM68); the nucleotide sequence of 6AAAA (MM84); the nucleotide sequence of FIG. 6CCCC (MM107); the nucleotide sequence of FIG. 6EEEE (MM112); the nucleotide sequence of FIG. 6GGGG (MM115); the nucleotide sequence of FIG. 6IIII (MM120); the nucleotide sequence of FIG. 6KKKK (MM123); the nucleotide sequence of FIG. 6MMMM (MM136); the nucleotide sequence of FIG. 6OOOO (MM138); the nucleotide sequence of FIG. 6QQQQ (MM141); the nucleotide sequence of FIG. 6SSSS (MM144), or the nucleotide sequence of FIG. 6UUUU (MM153); or a nucleotide sequence that encodes an AAV capsid encoded by the nucleotide sequence of any of the foregoing but that differs from the nucleotide sequences above due to the degeneracy of the genetic code, which allows different nucleic acid sequences to code for the same polypeptide.

The invention also provides nucleic acids encoding the AAV capsid variants, capsid protein variants and fusion proteins as described above. In particular embodiments, the nucleic acid hybridizes to the complement of the nucleic acid sequences specifically disclosed herein (e.g., see FIGS. 3B, 3E, 3H, 3K, 3N, 3Q, 3T, 3W, 3Z, 3CC, 3FF, 3II, 3LL, 3OO, 3RR, 3UU, 3XX, 3AAA, 3DDD, 6A, 6C, 6E, 6G, 6I, 6K, 6M, 6O, 6Q, 6S, 6U, 6W, 6Y, 6AA, 6CC, 6EE, 6GG, 6II, 6KK, 6MM, 6OO, 6QQ, 6SS, 6UU, 6WW, 6YY, 6AAA, 6CCC, 6EEE, 6GGG, 6III, 6KKK, 6MMM, 6OOO, 6QQQ, 6SSS, 6UUU, 6WWW, 6YYY, 6AAAA, 6CCCC, 6EEEE, 6GGGG, 6IIII, 6KKKK, 6MMMM, 6OOOO, 6QQQQ, 6SSSS and/or 6UUUU) under standard conditions as known by those skilled in the art and encodes a variant capsid and/or capsid protein. Optionally, the variant capsid or capsid protein substantially retains at least one property of the capsid and/or capsid or capsid protein encoded by the nucleic acid sequences of FIGS. 3B, 3E, 3H, 3K, 3N, 3Q, 3T, 3W, 3Z, 3CC, 3FF, 3II, 3LL, 3OO, 3RR, 3UU, 3XX, 3AAA, 3DDD, 6A, 6C, 6E, 6G, 6I, 6K, 6M, 6O, 6Q, 6S, 6U, 6W, 6Y, 6AA, 6CC, 6EE, 6GG, 6II, 6KK, 6MM, 6OO, 6QQ, 6SS, 6UU, 6WW, 6YY, 6AAA, 6CCC, 6EEE, 6GGG, 6III, 6KKK, 6MMM, 6OOO, 6QQQ, 6SSS, 6UUU, 6WWW, 6YYY, 6AAAA, 6CCCC, 6EEEE, 6GGGG, 6IIII, 6KKKK, 6MMMM, 6OOOO, 6QQQQ, 6SSSS and/or 6UUUU. For example, a virus particle comprising the variant capsid or variant capsid protein can substantially retain the tropism profile of a virus particle comprising a capsid or capsid protein encoded by a nucleic acid coding sequence as shown in FIGS. 3B, 3E, 3H, 3K, 3N, 3Q, 3T, 3W, 3Z, 3CC, 3FF, 3II, 3LL, 3OO, 3RR, 3UU, 3XX, 3AAA, 3DDD, 6A, 6C, 6E, 6G, 6I, 6K, 6M, 6O, 6Q, 6S, 6U, 6W, 6Y, 6AA, 6CC, 6EE, 6GG, 6II, 6KK, 6MM, 6OO, 6QQ, 6SS, 6UU, 6WW, 6YY, 6AAA, 6CCC, 6EEE, 6GGG, 6III, 6KKK, 6MMM, 6OOO, 6QQQ, 6SSS, 6UUU, 6WWW, 6YYY, 6AAAA, 6CCCC, 6EEEE, 6GGGG, 6IIII, 6KKKK, 6MMMM, 6OOOO, 6QQQQ, 6SSSS and/or 6UUUU (e.g., inefficient transduction of liver and/or efficient transduction of skeletal muscle, cardiac muscle and/or tongue muscle).

For example, hybridization of such sequences may be carried out under conditions of reduced stringency, medium stringency or even stringent conditions. Exemplary conditions for reduced, medium and stringent hybridization are as follows: (e.g., conditions represented by a wash stringency of 35-40% Formamide with 5×Denhardt's solution, 0.5% SDS and 1×SSPE at 37° C.; conditions represented by a wash stringency of 40-45% Formamide with 5×Denhardt's solution, 0.5% SDS, and 1×SSPE at 42° C.; and conditions represented by a wash stringency of 50% Formamide with 5×Denhardt's solution, 0.5% SDS and 1×SSPE at 42° C., respectively). See, e.g., Sambrook et al., *Molecular Cloning, A Laboratory Manual* (2d Ed. 1989) (Cold Spring Harbor Laboratory).

In other embodiments, nucleic acid sequences encoding a variant capsid or capsid protein of the invention have at least about 60%, 70%, 80%, 85%, 90%, 95%, 97% or higher sequence identity with the nucleic acid sequences specifically disclosed in FIGS. 3B, 3E, 3H, 3K, 3N, 3Q, 3T, 3W, 3Z, 3CC, 3FF, 3II, 3LL, 3OO, 3RR, 3UU, 3XX, 3AAA, 3DDD, 6A, 6C, 6E, 6G, 6I, 6K, 6M, 6O, 6Q, 6S, 6U, 6W, 6Y, 6AA, 6CC, 6EE, 6GG, 6II, 6KK, 6MM, 6OO, 6QQ, 6SS, 6UU, 6WW, 6YY, 6AAA, 6CCC, 6EEE, 6GGG, 6III, 6KKK, 6MMM, 6OOO, 6QQQ, 6SSS, 6UUU, 6WWW, 6YYY, 6AAAA, 6CCCC, 6EEEE, 6GGGG, 6IIII, 6KKKK, 6MMMM, 6OOOO, 6QQQQ, 6SSSS and/or 6UUUU) and optionally encode a variant capsid or capsid protein that substantially retains at least one property of the capsid or capsid protein encoded by a nucleic acid as shown in FIGS. 3B, 3E, 3H, 3K, 3N, 3Q, 3T, 3W, 3Z, 3CC, 3FF, 3II, 3LL, 3OO, 3RR, 3UU, 3XX, 3AAA, 3DDD, 6A, 6C, 6E, 6G, 6I, 6K, 6M, 6O, 6Q, 6S, 6U, 6W, 6Y, 6AA, 6CC, 6EE, 6GG, 6II, 6KK, 6MM, 6OO, 6QQ, 6SS, 6UU, 6WW, 6YY, 6AAA, 6CCC, 6EEE, 6GGG, 6III, 6KKK, 6MMM, 6OOO, 6QQQ, 6SSS, 6UUU, 6WWW, 6YYY, 6AAAA, 6CCCC, 6EEEE, 6GGGG, 6IIII, 6KKKK, 6MMMM, 6OOOO, 6QQQQ, 6SSSS and/or 6UUUU.

As is known in the art, a number of different programs can be used to identify whether a nucleic acid or polypeptide has sequence identity to a known sequence. Percent identity as used herein means that a nucleic acid or fragment thereof shares a specified percent identity to another nucleic acid, when optimally aligned (with appropriate nucleotide insertions or deletions) with the other nucleic acid (or its complementary strand), using BLASTN. To determine percent identity between two different nucleic acids, the percent identity is to be determined using the BLASTN program "BLAST 2 sequences". This program is available for public use from the National Center for Biotechnology Information (NCBI) over the Internet (Altschul et al., (1997) *Nucleic Acids Res.* 25(17): 3389-3402). The parameters to be used are whatever combination of the following yields the highest calculated percent identity (as calculated below) with the default parameters shown in parentheses: Program—blastn Matrix—0 BLOSUM62 Reward for a match—0 or 1 (1) Penalty for a mismatch—0, −1, −2 or −3 (−2) Open gap penalty—0, 1, 2, 3, 4 or 5 (5) Extension gap penalty—0 or 1 (1) Gap x_dropoff—0 or 50 (50) Expect—10.

Percent identity or similarity when referring to polypeptides, indicates that the polypeptide in question exhibits a specified percent identity or similarity when compared with another protein or a portion thereof over the common lengths as determined using BLASTP. This program is also available for public use from the National Center for Biotechnology Information (NCBI) over the Internet (Altschul et al., (1997) *Nucleic Acids Res.* 25(17):3389-3402). Percent identity or similarity for polypeptides is typically measured using sequence analysis software. See, e.g., the Sequence Analysis Software Package of the Genetics Computer Group, University of Wisconsin Biotechnology Center, 910 University Avenue, Madison, Wis. 53705. Protein analysis software matches similar sequences using measures of homology assigned to various substitutions, deletions and other modifications. Conservative substitutions typically include substitutions within the following groups: glycine, alanine; valine, isoleucine, leucine; aspartic acid, glutamic acid; asparagine, glutamine; serine, threonine; lysine, arginine; and phenylalanine, tyrosine.

In particular embodiments, the nucleic acid can comprise, consist of, or consist essentially of a vector including but not limited to a plasmid, phage, viral vector (e.g., AAV vector, an adenovirus vector, a herpesvirus vector, or a baculovirus vector), bacterial artificial chromosome (BAC), or yeast artificial chromosome (YAC). For example, the nucleic acid can comprise, consist of, or consist essentially of an AAV vector comprising a 5' and/or 3' terminal repeat (e.g., 5' and/or 3' AAV terminal repeat).

In some embodiments the nucleic acid encoding the scrambled AAV capsid protein further comprises an AAV Rep coding sequence. For example, the nucleic acid can be a helper construct for producing viral stocks.

The invention also provides packaging cells stably comprising a nucleic acid of the invention. For example, the nucleic acid can be stably incorporated into the genome of the cell or can be stably maintained in an episomal form (e.g., an "EBV based nuclear episome").

The nucleic acid can be incorporated into a delivery vector, such as a viral delivery vector. To illustrate, the nucleic acid of the invention can be packaged in an AAV particle, an adenovirus particle, a herpesvirus particle, a baculovirus particle, or any other suitable virus particle.

Moreover, the nucleic acid can be operably associated with a promoter element. Promoter elements are described in more detail herein.

The present invention further provides methods of producing the virus vectors of the invention. In a representative embodiment, the present invention provides a method of producing a recombinant virus vector, the method comprising providing to a cell in vitro, (a) a template comprising (i) a heterologous nucleic acid, and (ii) packaging signal sequences sufficient for the encapsidation of the AAV template into virus particles (e.g., one or more [e.g., two] terminal repeats, such as AAV terminal repeats), and (b) AAV sequences sufficient for replication and encapsidation of the template into viral particles (e.g., the AAV rep and AAV cap sequences encoding an AAV capsid of the invention). The template and AAV replication and capsid sequences are provided under conditions such that recombinant virus particles comprising the template packaged within the capsid are produced in the cell. The method can further comprise the step of collecting the virus particles from the cell. Virus particles may be collected from the medium and/or by lysing the cells.

In one illustrative embodiment, the invention provides a method of producing a rAAV particle comprising an AAV capsid, the method comprising: providing a cell in vitro with a nucleic acid encoding a scrambled AAV capsid of the invention, an AAV rep coding sequence, an AAV vector genome comprising a heterologous nucleic acid, and helper functions for generating a productive AAV infection; and allowing assembly of the AAV particles comprising the AAV capsid and encapsidating the AAV vector genome.

The cell is typically a cell that is permissive for AAV viral replication. Any suitable cell known in the art may be employed, such as mammalian cells. Also suitable are trans-complementing packaging cell lines that provide functions deleted from a replication-defective helper virus, e.g., 293 cells or other E1a trans-complementing cells.

The AAV replication and capsid sequences may be provided by any method known in the art. Current protocols typically express the AAV rep/cap genes on a single plasmid. The AAV replication and packaging sequences need not be provided together, although it may be convenient to do so. The AAV rep and/or cap sequences may be provided by any viral or non-viral vector. For example, the rep/cap sequences may be provided by a hybrid adenovirus or herpesvirus vector (e.g., inserted into the E1a or E3 regions of a deleted adenovirus vector). EBV vectors may also be employed to express the AAV cap and rep genes. One advantage of this method is that EBV vectors are episomal, yet will maintain a high copy number throughout successive cell divisions (i.e., are stably integrated into the cell as extra-chromosomal elements, designated as an EBV based nuclear episome.

As a further alternative, the rep/cap sequences may be stably carried (episomal or integrated) within a cell.

Typically, the AAV rep/cap sequences will not be flanked by the AAV packaging sequences (e.g., AAV ITRs), to prevent rescue and/or packaging of these sequences.

The template (e.g., an rAAV vector genome) can be provided to the cell using any method known in the art. For example, the template may be supplied by a non-viral (e.g., plasmid) or viral vector. In particular embodiments, the template is supplied by a herpesvirus or adenovirus vector (e.g., inserted into the E1a or E3 regions of a deleted adenovirus). As another illustration, Palombo et al., (1998) J. Virology 72:5025, describe a baculovirus vector carrying a reporter gene flanked by the AAV ITRs. EBV vectors may also be employed to deliver the template, as described above with respect to the rep/cap genes.

In another representative embodiment, the template is provided by a replicating rAAV virus. In still other embodiments, an AAV provirus is stably integrated into the chromosome of the cell.

To obtain maximal virus titers, helper virus functions (e.g., adenovirus or herpesvirus) essential for a productive AAV infection are generally provided to the cell. Helper virus sequences necessary for AAV replication are known in the art. Typically, these sequences are provided by a helper adenovirus or herpesvirus vector. Alternatively, the adenovirus or herpesvirus sequences can be provided by another non-viral or viral vector, e.g., as a non-infectious adenovirus miniplasmid that carries all of the helper genes required for efficient AAV production as described by Ferrari et al., (1997) Nature. Med. 3:1295, and U.S. Pat. Nos. 6,040,183 and 6,093,570.

Further, the helper virus functions nay be provided by a packaging cell with the helper genes integrated in the chromosome or maintained as a stable extrachromosomal element. In representative embodiments, the helper virus sequences cannot be packaged into AAV virions, e.g., are not flanked by AAV ITRs.

Those skilled in the art will appreciate that it may be advantageous to provide the AAV replication and capsid sequences and the helper virus sequences (e.g., adenovirus sequences) on a single helper construct. This helper construct may be a non-viral or viral construct, but is optionally a hybrid adenovirus or hybrid herpesvirus comprising the AAV rep/cap genes.

In one particular embodiment, the AAV rep/cap sequences and the adenovirus helper sequences are supplied by a single adenovirus helper vector. This vector further contains the rAAV template. The AAV rep/cap sequences and/or the rAAV template may be inserted into a deleted region (e.g., the E1a or E3 regions) of the adenovirus.

In a further embodiment, the AAV rep/cap sequences and the adenovirus helper sequences are supplied by a single adenovirus helper vector. The rAAV template is provided as a plasmid template.

In another illustrative embodiment, the AAV rep/cap sequences and adenovirus helper sequences are provided by a single adenovirus helper vector, and the rAAV template is integrated into the cell as a provirus. Alternatively, the rAAV template is provided by an EBV vector that is maintained within the cell as an extrachromosomal element (e.g., as a "EBV based nuclear episome," see Margolski, (1992) Curr. Top. Microbiol. Immun. 158:67).

In a further exemplary embodiment, the AAV rep/cap sequences and adenovirus helper sequences are provided by a single adenovirus helper. The rAAV template is provided as a separate replicating viral vector. For example, the rAAV template may be provided by a rAAV particle or a second recombinant adenovirus particle.

According to the foregoing methods, the hybrid adenovirus vector typically comprises the adenovirus 5' and 3' cis sequences sufficient for adenovirus replication and packaging (i.e., the adenovirus terminal repeats and PAC sequence). The AAV rep/cap sequences and, if present, the rAAV template are embedded in the adenovirus backbone and are flanked by the 5' and 3' cis sequences, so that these sequences may be packaged into adenovirus capsids. As described above, in representative embodiments, the adenovirus helper sequences and the AAV rep/cap sequences are not flanked by the AAV packaging sequences (e.g., the AAV ITRs), so that these sequences are not packaged into the AAV virions.

Herpesvirus may also be used as a helper virus in AAV packaging methods. Hybrid herpes viruses encoding the AAV Rep protein(s) may advantageously facilitate for more scalable AAV vector production schemes. A hybrid herpes simplex virus type I (HSV-1) vector expressing the AAV-2 rep and cap genes has been described (Conway et al., (1999) Gene Therapy 6:986 and WO 00/17377, the disclosures of which are incorporated herein in their entireties).

As a further alternative, the virus vectors of the invention can be produced in insect cells using baculovirus vectors to deliver the rep/cap genes and rAAV template as described by Urabe et al., (2002) Human Gene Therapy 13:1935-43.

Other methods of producing AAV use stably transformed packaging cells (see, e.g., U.S. Pat. No. 5,658,785).

AAV vector stocks free of contaminating helper virus may be obtained by any method known in the art. For example, AAV and helper virus may be readily differentiated based on size. AAV may also be separated away from helper virus based on affinity for a heparin substrate (Zolotukhin et al. (1999) *Gene Therapy* 6:973). In representative embodiments, deleted replication-defective helper viruses are used so that any contaminating helper virus is not replication competent. As a further alternative, an adenovirus helper lacking late gene expression may be employed, as only adenovirus early gene expression is required to mediate packaging of AAV virus. Adenovirus mutants defective for late gene expression are known in the art (e.g., ts100K and ts149 adenovirus mutants).

The inventive packaging methods may be employed to produce high titer stocks of virus particles. In particular embodiments, the virus stock has a titer of at least about $10^5$ transducing units (tu)/ml, at least about $10^6$ tu/ml, at least about $10^7$ tu/ml, at least about $10^8$ tu/ml, at least about $10^9$ tu/ml, or at least about $10^{10}$ tu/ml.

The novel capsid protein and capsid structures find use in raising antibodies, for example, for diagnostic or therapeutic uses or as a research reagent. Thus, the invention also provides antibodies against the novel capsid proteins and capsids of the invention.

The term "antibody" or "antibodies" as used herein refers to all types of immunoglobulins, including IgG, IgM, IgA, IgD, and IgE. The antibody can be monoclonal or polyclonal and can be of any species of origin, including (for example) mouse, rat, rabbit, horse, goat, sheep or human, or can be a chimeric antibody. See, e.g., Walker et al., *Molec. Immunol.* 26, 403-11 (1989). The antibodies can be recombinant monoclonal antibodies, for example, produced according to the methods disclosed in U.S. Pat. No. 4,474,893 or U.S. Pat. No. 4,816,567. The antibodies can also be chemically constructed, for example, according to the method disclosed in U.S. Pat. No. 4,676,980.

Antibody fragments included within the scope of the present invention include, for example, Fab, F(ab')2, and Fc fragments, and the corresponding fragments obtained from antibodies other than IgG. Such fragments can be produced by known techniques. For example, F(ab')2 fragments can be produced by pepsin digestion of the antibody molecule, and Fab fragments can be generated by reducing the disulfide bridges of the F(ab')2 fragments. Alternatively, Fab expression libraries can be constructed to allow rapid and easy identification of monoclonal Fab fragments with the desired specificity (Huse et al., (1989) *Science* 254, 1275-1281).

Polyclonal antibodies can be produced by immunizing a suitable animal (e.g., rabbit, goat, etc.) with an antigen to which a monoclonal antibody to the target binds, collecting immune serum from the animal, and separating the polyclonal antibodies from the immune serum, in accordance with known procedures.

Monoclonal antibodies can be produced in a hybridoma cell line according to the technique of Kohler and Milstein, (1975) *Nature* 265, 495-97. For example, a solution containing the appropriate antigen can be injected into a mouse and, after a sufficient time, the mouse sacrificed and spleen cells obtained. The spleen cells are then immortalized by fusing them with myeloma cells or with lymphoma cells, typically in the presence of polyethylene glycol, to produce hybridoma cells. The hybridoma cells are then grown in a suitable medium and the supernatant screened for monoclonal antibodies having the desired specificity. Monoclonal Fab fragments can be produced in *E. coli* by recombinant techniques known to those skilled in the art. See, e.g., W. Huse, (1989) *Science* 246, 1275-81.

Antibodies specific to a target polypeptide can also be obtained by phage display techniques known in the art.

Various immunoassays can be used for screening to identify antibodies having the desired specificity. Numerous protocols for competitive binding or immunoradiometric assays using either polyclonal or monoclonal antibodies with established specificity are well known in the art. Such immunoassays typically involve the measurement of complex formation between an antigen and its specific antibody (e.g., antigen/antibody complex formation). A two-site, monoclonal-based immunoassay utilizing monoclonal antibodies reactive to two non-interfering epitopes can be used as well as a competitive binding assay.

Antibodies can be conjugated to a solid support (e.g., beads, plates, slides or wells formed from materials such as latex or polystyrene) in accordance with known techniques. Antibodies can likewise be conjugated to detectable groups such as radiolabels (e.g. $^{35}$S, $^{125}$I, $^{131}$I), enzyme labels (e.g., horseradish peroxidase, alkaline phosphatase), and fluorescence labels (e.g., fluorescein) in accordance with known techniques. Determination of the formation of an antibody/antigen complex in the methods of this invention can be by detection of, for example, precipitation, agglutination, flocculation, radioactivity, color development or change, fluorescence, luminescence, etc., as is well known in the art.

The present invention also encompasses methods for delivering heterologous nucleotide sequences into a broad range of cells, including dividing and non-dividing cells. The virus vectors of the invention may be employed to deliver a nucleotide sequence of interest to a cell in vitro, e.g., to produce a polypeptide in vitro or for ex vivo gene therapy. The vectors are additionally useful in a method of delivering a nucleotide sequence to a subject in need thereof, e.g., to express an immunogenic or therapeutic polypeptide. In this manner, the polypeptide may thus be produced in vivo in the subject. The subject may be in need of the polypeptide because the subject has a deficiency of the polypeptide, or because the production of the polypeptide in the subject may impart some therapeutic effect, as a method of treatment or otherwise, and as explained further below.

In general, the virus vectors of the invention may be employed to deliver any foreign nucleic acid with a biological effect to treat or ameliorate the symptoms associated with any disorder related to gene expression. Further, the invention can be used to treat any disease state for which it is beneficial to deliver a therapeutic polypeptide. Illustrative disease states include, but are not limited to: cystic fibrosis (cystic fibrosis transmembrane regulator protein) and other diseases of the lung, hemophilia A (Factor VIII), hemophilia B (Factor IX), thalassemia (β-globin), anemia (erythropoietin) and other blood disorders, Alzheimer's disease (GDF; neprilysin), multiple sclerosis (β-interferon), Parkinson's disease (glial-cell line derived neurotrophic factor [GDNF]), Huntington's disease (inhibitory RNA including without limitation RNAi such as siRNA or shRNA, antisense RNA or microRNA to remove repeats), amyotrophic lateral sclerosis, epilepsy (galanin, neurotrophic factors), and other neurological disorders, cancer (endostatin, angiostatin, TRAIL, FAS-ligand, cytokines including interferons; inhibitory RNA including without limitation RNAi (such as siRNA or shRNA), antisense RNA and microRNA including inhibitory RNA against VEGF, the multiple drug resistance gene product or a cancer immunogen), diabetes mellitus (insulin, PGC-α1, GLP-1, myostatin pro-peptide, glucose transporter 4), muscular dystrophies including Duchenne and Becker (e.g., dystrophin, mini-dystrophin, micro-dystrophin, insulin-like growth factor I, a sarcoglycan [e.g., α, β, γ], Inhibitory RNA [e.g., RNAi, antisense RNA or microRNA] against myostatin or myostatin propeptide, laminin-alpha2, Fukutan-related protein, dominant negative myostatin, follistatin, activin type II soluble receptor, anti-inflammatory polypeptides such as the Ikappa B dominant mutant, sarcospan, utrophin, mini-utrophin, inhibitory RNA [e.g., RNAi, antisense RNA or microRNA] against splice junctions in the dystrophin gene to induce exon skipping [see, e.g., WO/2003/095647], inhibitory RNA (e.g., RNAi, antisense RNA or micro RNA) against U7 snRNAs to induce exon skipping [see, e.g., WO/2006/021724], and antibodies or antibody fragments against myostatin or myostatin propeptide), Gaucher disease (glucocerebrosidase), Hurler's disease (α-L-iduronidase), adenosine deaminase deficiency (adenosine deaminase), glycogen storage diseases (e.g., Fabry disease [α-galactosidase] and Pompe disease [lysosomal acid α-glucosidase]) and other metabolic defects including other lysosomal storage disorders and glycogen storage disorders, congenital emphysema (α1-antitrypsin), Lesch-Nyhan Syndrome (hypoxanthine guanine phosphoribosyl transferase), Niemann-Pick disease (sphingomyelinase), Maple Syrup Urine Disease (branched-chain keto acid dehydrogenase), retinal degenerative diseases (and other diseases of the eye and retina; e.g., PDGF, endostatin and/or angiostatin for macular degeneration), diseases of solid organs such as brain (including Parkinson's Disease [GDNF], astrocytomas [endostatin, angiostatin and/or RNAi against VEGF], glioblastomas [endostatin, angiostatin and/or RNAi against VEGF]), liver (RNAi such as siRNA or shRNA, microRNA or antisense RNA for hepatitis B and/or hepatitis C genes), kidney, heart including congestive heart failure or peripheral artery disease (PAD) (e.g., by delivering protein phosphatase inhibitor I [I-1], phospholamban, sarcoplasmic endoreticulum $Ca^{2+}$-ATPase [serca2a], zinc finger proteins that regulate the phospholamban gene, Pim-1, PGC-1α, SOD-1, SOD-2, ECF-SOD, kallikrein, thymosin-β4, hypoxia-inducible transcription factor [HIF], βarkct, β2-adrenergic receptor, β2-adrenergic receptor kinase [βARK], phosphoinositide-3 kinase [PI3 kinase], calsarcin, an angiogenic factor, S100A1, parvalbumin, adenylyl cyclase type 6, a molecule that effects G-protein coupled receptor kinase type 2 knockdown such as a truncated constitutively active bARKct, an inhibitory RNA [e.g., RNAi, antisense RNA or microRNA] against phospholamban; pholamban inhibitory or dominant-negative molecules such as phospholamban S16E, etc.), arthritis (insulin-like growth factors), joint disorders (insulin-like growth factors), intimal hyperplasia (e.g., by delivering enos, inos), improve survival of heart transplants (superoxide dismutase), AIDS (soluble CD4), muscle wasting (insulin-like growth factor I, myostatin pro-peptide, an anti-apoptotic factor, follistatin), limb ischemia (VEGF, FGF, PGC-1α, EC-SOD, HIF), kidney deficiency (erythropoietin), anemia (erythropoietin), arthritis (anti-inflammatory factors such as IRAP and TNFα soluble receptor), hepatitis (α-interferon), LDL receptor deficiency (LDL receptor), hyperammonemia (ornithine transcarbamylase), spinal cerebral ataxias including SCA1, SCA2 and SCA3, phenylketonuria (phenylalanine hydroxylase), autoimmune diseases, and the like. The invention can further be used following organ transplantation to increase the success of the transplant and/or to reduce the negative side effects of organ transplantation or adjunct therapies (e.g., by administering immunosuppressant agents or inhibitory nucleic acids to block cytokine production). As another example, bone morphogenic proteins (including RANKL and/or VEGF) can be administered with a bone allograft, for example, following a break or surgical removal in a cancer patient.

Exemplary lysosomal storage diseases that can be treated according to the present invention include without limitation: Hurler's Syndrome (MPS IH), Scheie's Syndrome (MPS IS), and Hurler-Scheie Syndrome (MPS IH/S) (α-L-iduronidase); Hunter's Syndrome (MPS II) (iduronate sulfate sulfatase); Sanfilippo A Syndrome (MPS IIIA) (Heparan-S-sulfate sulfaminidase), Sanfilippo B Syndrome (MPS IIIB) (N-acetyl-D-glucosaminidase), Sanfilippo C Syndrome (MPS IIIC) (Acetyl-CoA-glucosaminide N-acetyltransferase), Sanfilippo D Syndrome (MPS IIID) (N-acetyl-glucosaminine-6-sulfate sulfatase); Morquio A disease (MPS IVA) (Galactosamine-6-sulfate sulfatase), Morquio B disease (MPS IV B) (β-Galactosidase); Maroteaux-Imay disease (MPS VI) (arylsulfatase B); Sly Syndrome (MPS VII) (β-glucuronidase); hyaluronidase deficiency (MPS IX) (hyaluronidase); sialidosis (mucolipidosis I), mucolipidosis II (I-Cell disease) (N-actylglucos-aminyl-1-phosphotransferase catalytic subunit), mucolipidosis III (pseudo-Hurler polydystrophy) (N-acetyl-glucos-aminyl-1-phosphotransferase; type IIIA [catalytic subunit] and type IIIC [substrate recognition subunit]); GM1 gangliosidosis (ganglioside β-galactosidase), GM2 gangliosidosis Type I (Tay-Sachs disease) (β-hexaminidase A), GM2 gangliosidosis type II (Sandhoff's disease) (β-hexosaminidase B); Niemann-Pick disease (Types A and B) (sphingomyelinase); Gaucher's disease (glucocerebrosidase); Farber's disease (ceraminidase); Fabry's disease (α-galactosidase A); Krabbe's disease (galactosylceramide β-galactosidase); metachromatic leukodystrophy (arylsulfatase A); lysosomal acid lipase deficiency including Wolman's disease (lysosomal acid lipase); Batten disease (juvenile neuronal ceroid lipofuscinosis) (lysosomal transmembrane CLN3 protein) sialidosis (neuraminidase 1); galactosialidosis (Goldberg's syndrome) (protective protein/cathepsin A); α-mannosidosis (α-D-mannosidase); β-mannosidosis (β-D-mannosidosis); fucosidosis (α-D-fucosidase); aspartylglucosaminuria (N-Aspartylglucosaminidase); and sialuria (Na phosphate cotransporter).

Exemplary glycogen storage diseases that can be treated according to the present invention include, but are not limited to, Type Ia GSD (von Gierke disease) (glucose-6-phosphatase), Type Ib GSD (glucose-6-phophate translocase), Type Ic GSD (microsomal phosphate or pyrophosphate transporter), Type Id GSD (microsomal glucose transporter), Type II GSD including Pompe disease or infantile Type IIa GSD (lysosomal acid α-glucosidase) and Type IIb (Danon) (lysosomal membrane protein-2), Type IIIa and IIIb GSD (Debrancher enzyme; amyloglucosidase and oligoglucanotransferase), Type IV GSD (Andersen's disease) (branching enzyme), Type V GSD (McArdle disease) (muscle phosphorylase), Type VI GSD (Hers' disease) (liver phosphorylase), Type VII GSD (Tarui's disease) (phosphofructokinase), GSD Type VIII/IXa (X-linked phosphorylase kinase), GSD Type IXb (Liver and muscle phosphorylase kinase), GSD Type IXc (liver phosphorylase kinase), GSD Type IXd (muscle phosphorylase kinase), GSD O (glycogen synthase), Fanconi-Bickel syndrome (glucose transporter-2), phosphoglucoisomerase deficiency, muscle phosphoglycerate kinase deficiency, phosphoglycerate mutase deficiency, fructose 1,6-diphosphatase deficiency, phosphoenolpyruvate carboxykinase deficiency, and lactate dehydrogenase deficiency.

Nucleic acids and polypeptides that can be delivered to cardiac muscle include those that are beneficial in the treatment of damaged, degenerated or atrophied cardiac muscle and/or congenital cardiac defects. For example, angiogenic factors useful for facilitating vascularization in the treatment of heart disease include but are not limited to vascular endothelial growth factor (VEGF), VEGF II, VEGF-B, VEGF-C, VEGF-D, VEGF-E, $VEGF_{121}$, $VEGF_{138}$, $VEGF_{145}$, $VEGF_{165}$, $VEGF_{189}$, $VEGF_{206}$, hypoxia inducible factor 1α (HIF 1α), endothelial NO synthase (eNOS), iNOS, VEFGR-1 (Flt1), VEGFR-2 (KDR/Flk1), VEGFR-3 (Flt4), angiogenin, epidermal growth factor (EGF), angiopoietin, platelet-derived growth factor, angiogenic factor, transforming growth factor-α (TGF-α), transforming growth factor-β (TGF-β), vascular permeability factor (VPF), tumor necrosis factor alpha (TNF-α), interleukin-3 (IL-3), interleukin-8 (IL-8), platelet-derived endothelial growth factor (PD-EGF), granulocyte colony stimulating factor (G-CSF), hepatocyte growth factor (HGF), scatter factor (SF), pleitrophin, proliferin, follistatin, placental growth factor (PlGF), midkine, platelet-derived growth factor-BB (PDGF), fractalkine, ICAM-1, angiopoietin-1 and -2 (Ang1 and Ang2), Tie-2, neuropilin-1, ICAM-1, chemokines and cytokines that stimulate smooth muscle cell, monocyte, or leukocyte migration, anti-apoptotic peptides and proteins, fibroblast growth factors (FGF), FGF-1, FGF-1b, FGF-1c, FGF-2, FGF-2b, FGF-2c, FGF-3, FGF-3b, FGF-3c, FGF-4, FGF-5, FGF-7, FGF-9, acidic FGF, basic FGF, monocyte chemotactic protein-1, granulocyte macrophage-colony stimulating factor, insulin-like growth factor-1 (IGF-1), IGF-2, early growth response factor-1 (EGR-1), ETS-1, human tissue kallikrein (HK), matrix metalloproteinase, chymase, urokinase-type plasminogen activator and heparinase. (see, e.g., U.S. Patent Application No. 20060287259 and U.S. Patent Application No. 20070059288).

The most common congenital heart disease found in adults is bicuspid aortic valve, whereas atrial septal defect is responsible for 30-40% of congenital heart disease seen in adults. The most common congenital cardiac defect observed in the pediatric population is ventricular septal defect. Other congenital heart diseases include Eisenmenger's syndrome, patent ductus arteriosus, pulmonary stenosis, coarctation of the aorta, transposition of the great arteries, tricuspid atresia, univentricular heart, Ebstein's anomaly, and double-outlet right ventricle. A number of studies have identified putative genetic loci associated with one or more of these congenital heart diseases. For example, the putative gene(s) for congenital heart disease associated with Down syndrome is 21q22.2-q22.3, between ETS2 and MX1. Similarly, most cases of DiGeorge syndrome result from a deletion of chromosome 22811.2 (the DiGeorge syndrome chromosome region, or DGCR). Several genes are lost in this deletion including the putative transcription factor TUPLE1. This deletion is associated with a variety of phenotypes, e.g., Shprintzen syndrome; conotruncal anomaly face (or Takao syndrome); and isolated outflow tract defects of the heart including Tetralogy of Fallot, truncus arteriosus, and interrupted aortic arch. All of the foregoing disorders can be treated according to the present invention.

Other significant diseases of the heart and vascular system are also believed to have a genetic, typically polygenic, etiological component. These diseases include, for example, hypoplastic left heart syndrome, cardiac valvular dysplasia, Pfeiffer cardiocranial syndrome, oculofaciocardiodental syndrome, Kapur-Toriello syndrome, Sonoda syndrome, Ohdo Blepharophimosis syndrome, heart-hand syndrome, Pierre-Robin syndrome, Hirschsprung disease, Kousseff syndrome, Grange occlusive arterial syndrome, Kearns-Sayre syndrome, Kartagener syndrome, Alagille syndrome, Ritscher-Schinzel syndrome, Ivemark syndrome, Young-Simpson syndrome, hemochromatosis, Holzgreve syndrome, Barth syndrome, Smith-Lemli-Opitz syndrome, glycogen storage disease, Gaucher-like disease, Fabry disease, Lowry-Maclean syndrome, Rett syndrome, Opitz syndrome, Marfan syndrome, Miller-Dieker lissencephaly syndrome, mucopolysaccharidosis, Bruada syndrome, humerospinal dysostosis, Phaver syndrome, McDonough syndrome, Marfanoid hypermobility syndrome, atransferrinemia, Cornelia de Lange syndrome, Leopard syndrome, Diamond-Blackfan anemia, Steinfeld syndrome, progeria, and Williams-Beuren syndrome. All of these disorders can be treated according to the present invention.

Anti-apoptotic factors can be delivered to skeletal muscle, diaphragm muscle and/or cardiac muscle to treat muscle wasting diseases, limb ischemia, cardiac infarction, heart failure, coronary artery disease and/or type I or type II diabetes.

Nucleic acids that can be delivered to skeletal muscle include those that are beneficial in the treatment of damaged, degenerated and/or atrophied skeletal muscle. The genetic defects that cause muscular dystrophy are known for many forms of the disease. These defective genes either fail to produce a protein product, produce a protein product that fails to function properly, or produce a dysfunctional protein product that interferes with the proper function of the cell. The heterologous nucleic acid may encode a therapeutically functional protein or a polynucleotide that inhibits production or activity of a dysfunctional protein. Polypeptides that may be expressed from delivered nucleic acids, or inhibited by delivered nucleic acids (e.g., by delivering RNAi, microRNA or antisense RNA), include without limitation dystrophin, a mini-dystrophin or a micro-dystrophin (Duchene's and Becker M D); dystrophin-associated glycoproteins β-sarcoglycan (limb-girdle MD 2E), δ-sarcoglycan (limb-girdle MD 2 2F), α-sarcoglycan (limb girdle MD 2D) and γ-sarcoglycan (limb-girdle MD 2C), utrophin, calpain (autosomal recessive limb-girdle MD type 2A), caveolin-3 (autosomal-dominant limb-girdle MD), laminin-alpha2 (merosin-deficient congenital MD), miniagrin (laminin-alpha2 deficient congenital MD), fukutin (Fukuyama type congenital MD), emerin (Emery-Dreifuss MD), myotilin, lamin NC, calpain-3, dysferlin, and/or telethonin. Further, the heterologous nucleic acid can encode mir-1, mir-133, mir-206, mir-208 or an antisense RNA, RNAi (e.g., siRNA or shRNA) or microRNA to induce exon skipping in a defective dystrophin gene.

In particular embodiments, the nucleic acid is delivered to tongue muscle (e.g., to treat dystrophic tongue). Methods of delivering to the tongue can be by any method known in the art including direct injection, oral administration, topical administration to the tongue, intravenous administration, intra-articular administration and the like.

The foregoing proteins can also be administered to diaphragm muscle to treat muscular dystrophy.

Alternatively, a gene transfer vector may be administered that encodes any other therapeutic polypeptide.

In particular embodiments, a virus vector according to the present invention is used to deliver a nucleic acid of interest as described herein to skeletal muscle, diaphragm muscle and/or cardiac muscle, for example, to treat a disorder associated with one or more of these tissues such as muscular dystrophy, heart disease (including PAD and congestive heart failure), and the like.

Gene transfer has substantial potential use in understanding and providing therapy for disease states. There are a number of inherited diseases in which defective genes are known and have been cloned. In general, the above disease states fall into two classes: deficiency states, usually of enzymes, which are generally inherited in a recessive manner, and unbalanced states, which may involve regulatory or structural proteins, and which are typically inherited in a dominant manner. For deficiency state diseases, gene transfer can be used to bring a normal gene into affected tissues for replacement therapy, as well as to create animal models for the disease using inhibitory RNA such as RNAi (e.g., siRNA or shRNA), microRNA or antisense RNA. For unbalanced disease states, gene transfer can be used to create a disease state in a model system, which can then be used in efforts to counteract the disease state. Thus, the virus vectors according to the present invention permit the treatment of genetic diseases. As used herein, a disease state is treated by partially or wholly remedying the deficiency or imbalance that causes the disease or makes it more severe. The use of site-specific recombination of nucleic sequences to cause mutations or to correct defects is also possible.

The virus vectors according to the present invention may also be employed to provide an antisense nucleic acid or inhibitory RNA (e.g., microRNA or RNAi such as a siRNA or shRNA) to a cell in vitro or in vivo. Expression of the inhibitory RNA in the target cell diminishes expression of a particular protein(s) by the cell. Accordingly, inhibitory RNA may be administered to decrease expression of a particular protein in a subject in need thereof. Inhibitory RNA may also be administered to cells in vitro to regulate cell physiology, e.g., to optimize cell or tissue culture systems.

Further, the virus vectors according to the present invention find further use in diagnostic and screening methods, whereby a gene of interest is transiently or stably expressed in a cell culture system, or alternatively, a transgenic animal model. The invention can also be practiced to deliver a nucleic acid for the purposes of protein production, e.g., for laboratory, industrial or commercial purposes.

As a further aspect, the virus vectors of the present invention may be used to produce an immune response in a subject. According to this embodiment, a virus vector comprising a nucleic acid encoding an immunogen may be administered to a subject, and an active immune response (optionally, a protective immune response) is mounted by the subject against the immunogen. Immunogens are as described hereinabove.

Alternatively, the virus vector may be administered to a cell ex vivo and the altered cell is administered to the subject. The heterologous nucleic acid is introduced into the cell, and the cell is administered to the subject, where the heterologous nucleic acid encoding the immunogen is optionally expressed and induces an immune response in the subject against the immunogen. In particular embodiments, the cell is an antigen-presenting cell (e.g., a dendritic cell).

An "active immune response" or "active immunity" is characterized by "participation of host tissues and cells after an encounter with the immunogen. It involves differentiation and proliferation of immunocompetent cells in lymphoreticular tissues, which lead to synthesis of antibody or the development of cell-mediated reactivity, or both." Herbert B. Herscowitz, *Immunophysiology: Cell Function and Cellular Interactions in Antibody Formation*, in IMMUNOLOGY: BASIC PROCESSES 117 (Joseph A. Bellanti ed., 1985). Alternatively stated, an active immune response is mounted by the host after exposure to immunogens by infection or by vaccination. Active immunity can be contrasted with passive immunity, which is acquired through the "transfer of preformed substances (antibody, transfer factor, thymic graft, interleukin-2) from an actively immunized host to a non-immune host." Id.

A "protective" immune response or "protective" immunity as used herein indicates that the immune response confers some benefit to the subject in that it prevents or reduces the incidence of disease. Alternatively, a protective immune response or protective immunity may be useful in the treatment of disease, in particular cancer or tumors (e.g., by causing regression of a cancer or tumor and/or by preventing metastasis and/or by preventing growth of metastatic nodules). The protective effects may be complete or partial, as long as the benefits of the treatment outweigh any disadvantages thereof.

The virus vectors of the present invention may also be administered for cancer immunotherapy by administration of a viral vector expressing a cancer cell antigen (or an immunologically similar molecule) or any other immunogen that produces an immune response against a cancer cell. To illustrate, an immune response may be produced against a cancer cell antigen in a subject by administering a viral vector comprising a heterologous nucleotide sequence encoding the cancer cell antigen, for example to treat a patient with cancer. The virus vector may be administered to a subject in vivo or by using ex vivo methods, as described herein.

As used herein, the term "cancer" encompasses tumor-forming cancers. Likewise, the term "cancerous tissue" encompasses tumors. A "cancer cell antigen" encompasses tumor antigens.

The term "cancer" has its understood meaning in the art, for example, an uncontrolled growth of tissue that has the potential to spread to distant sites of the body (i.e., metastasize). Exemplary cancers include, but are not limited to, leukemia, lymphoma (e.g., Hodgkin and non-Hodgkin lymphomas), colorectal cancer, renal cancer, liver cancer, breast cancer, lung cancer, prostate cancer, testicular cancer, ovarian cancer, uterine cancer, cervical cancer, brain cancer (e.g.; gliomas and glioblastoma), bone cancer, sarcoma, melanoma, head and neck cancer, esophageal cancer, thyroid cancer, and the like. In embodiments of the invention, the invention is practiced to treat and/or prevent tumor-forming cancers.

The term "tumor" is also understood in the art, for example, as an abnormal mass of undifferentiated cells within a multicellular organism. Tumors can be malignant or benign. In representative embodiments, the methods disclosed herein are used to prevent and treat malignant tumors.

Cancer cell antigens have been described hereinabove. By the terms "treating cancer" or "treatment of cancer," it is intended that the severity of the cancer is reduced or the cancer is prevented or at least partially eliminated. For example, in particular contexts, these terms indicate that metastasis of the cancer is prevented or reduced or at least partially eliminated. In further representative embodiments these terms indicate that growth of metastatic nodules (e.g., after surgical removal of a primary tumor) is prevented or reduced or at least partially eliminated. By the terms "prevention of cancer" or "preventing cancer" it is intended that the methods at least partially eliminate or reduce the incidence or onset of cancer. Alternatively stated, the onset or progression of cancer in the subject may be slowed, controlled, decreased in likelihood or probability, or delayed.

In particular embodiments, cells may be removed from a subject with cancer and contacted with a virus vector according to the present invention. The modified cell is then administered to the subject, whereby an immune response against the cancer cell antigen is elicited. This method is particularly advantageously employed with immunocompromised subjects that cannot mount a sufficient immune response in vivo (i.e., cannot produce enhancing antibodies in sufficient quantities).

It is known in the art that immune responses may be enhanced by immunomodulatory cytokines (e.g., α-interferon, β-interferon, γ-interferon, ω-interferon, τ-interferon, interleukin-1α, interleukin-1β, interleukin-2, interleukin-3, interleukin-4, interleukin 5, interleukin-6, interleukin-7, interleukin-8, interleukin-9, interleukin-10, interleukin-11, interleukin 12, interleukin-13, interleukin-14, interleukin-18, B cell Growth factor, CD40 Ligand, tumor necrosis factor-α, tumor necrosis factor-β, monocyte chemoattractant protein-1, granulocyte-macrophage colony stimulating factor, and lymphotoxin). Accordingly, immunomodulatory cytokines (e.g., CTL inductive cytokines) may be administered to a subject in conjunction with the virus vectors.

Cytokines may be administered by any method known in the art. Exogenous cytokines may be administered to the subject, or alternatively, a nucleotide sequence encoding a cytokine may be delivered to the subject using a suitable vector, and the cytokine produced in vivo.

Recombinant virus vectors according to the present invention find use in both veterinary and medical applications. Suitable subjects include both avians and mammals. The term "avian" as used herein includes, but is not limited to, chickens, ducks, geese, quail, turkeys, pheasant, parrots, parakeets. The term "mammal" as used herein includes, but is not limited to, humans, primates non-human primates (e.g., monkeys and baboons), cattle, sheep, goats, pigs, horses, cats, dogs, rabbits, rodents (e.g., rats, mice, hamsters, and the like), etc. Human subjects include neonates, infants, juveniles, and adults. Optionally, the subject is "in need of" the methods of the present invention, e.g., because the subject has or is believed at risk for a disorder including those described herein or that would benefit from the delivery of a nucleic acid including those described herein. For example, in particular embodiments, the subject has (or has had) or is at risk for a muscular dystrophy or heart disease (e.g., myocardial infarct, PAD, congestive heart failure, etc.). As a further option, the subject can be a laboratory animal and/or an animal model of disease.

In particular embodiments, the present invention provides a pharmaceutical composition comprising a virus vector of the invention in a pharmaceutically acceptable carrier and, optionally, other medicinal agents, pharmaceutical agents, stabilizing agents, buffers, carriers, adjuvants, diluents, etc. For injection, the carrier will typically be a liquid. For other methods of administration, the carrier may be either solid or liquid. For inhalation administration, the carrier will be respirable, and will preferably be in solid or liquid particulate form.

By "pharmaceutically acceptable" it is meant a material that is not toxic or otherwise undesirable, i.e., the material may be administered to a subject without causing any undesirable biological effects.

One aspect of the present invention is a method of transferring a nucleotide sequence to a cell in vitro. The virus vector may be introduced to the cells at the appropriate multiplicity of infection according to standard transduction methods appropriate for the particular target cells. Titers of the virus vector or capsid to administer can vary, depending upon the target cell type and number, and the particular virus vector or capsid, and can be determined by those of skill in the art without undue experimentation. In particular embodiments, at least about $10^3$ infectious units, more preferably at least about $10^5$ infectious units are introduced to the cell.

The cell(s) to be introduced the virus vector may be of any type, including but not limited to neural cells (including cells of the peripheral and central nervous systems, in particular, brain cells such as neurons, oligodendricytes, glial cells, astrocytes), lung cells, cells of the eye (including retinal cells, retinal pigment epithelium, and corneal cells), epithelial cells (e.g., gut and respiratory epithelial cells), skeletal muscle cells (including myoblasts, myotubes and myofibers), diaphragm muscle cells, dendritic cells, pancreatic cells (including islet cells), hepatic cells, a cell of the gastrointestinal tract (including smooth muscle cells, epithelial cells), heart cells (including cardiomyocytes), bone cells (e.g., bone marrow stem cells), hematopoietic stem cells, spleen cells, keratinocytes, fibroblasts, endothelial cells, prostate cells, joint cells (including, e.g., cartilage, meniscus, synovium and bone marrow), germ cells, and the like. Alternatively, the cell may be any progenitor cell. As a further alternative, the cell can be a stem cell (e.g., neural stem cell, liver stem cell). As still a further alternative, the cell may be a cancer or tumor cell (cancers and tumors are described above). Moreover, the cells can be from any species of origin, as indicated above.

The virus vectors may be introduced to cells in vitro for the purpose of administering the modified cell to a subject. In particular embodiments, the cells have been removed from a subject, the virus vector is introduced therein, and the cells are then replaced back into the subject. Methods of removing cells from subject for treatment ex vivo, followed by introduction back into the subject are known in the art (see, e.g., U.S. Pat. No. 5,399,346). Alternatively, the recombinant virus vector is introduced into cells from another subject, into cultured cells, or into cells from any other suitable source, and the cells are administered to a subject in need thereof.

Suitable cells for ex vivo gene therapy are as described above. Dosages of the cells to administer to a subject will vary upon the age, condition and species of the subject, the type of cell, the nucleic acid being expressed by the cell, the mode of administration, and the like. Typically, at least about $10^2$ to about $10^8$ or about $10^3$ to about $10^6$ cells will be administered per dose in a pharmaceutically acceptable carrier. In particular embodiments, the cells transduced with the virus vector are administered to the subject in an effective amount in combination with a pharmaceutical carrier.

In some embodiments, cells that have been transduced with the virus vector may be administered to elicit an immunogenic response against the delivered polypeptide (e.g., expressed as a transgene or in the capsid). Typically, a quantity of cells expressing an effective amount of the polypeptide in combination with a pharmaceutically acceptable carrier is administered. Optionally, the dosage is sufficient to produce a protective immune response (as defined above). The degree of protection conferred need not be complete or permanent, as long as the benefits of administering the immunogenic polypeptide outweigh any disadvantages thereof.

A further aspect of the invention is a method of administering the virus vectors or capsids of the invention to subjects. In particular embodiments, the method comprises a method of delivering a nucleic acid of interest to an animal subject, the method comprising: administering an effective amount of a virus vector according to the invention to an animal subject. Administration of the virus vectors of the present invention to a human subject or an animal in need thereof can be by any means known in the art. Optionally, the virus vector is delivered in an effective dose in a pharmaceutically acceptable carrier.

The virus vectors of the invention can further be administered to a subject to elicit an immunogenic response (e.g., as a vaccine). Typically, vaccines of the present invention comprise an effective amount of virus in combination with a pharmaceutically acceptable carrier. Optionally, the dosage is sufficient to produce a protective immune response (as defined above). The degree of protection conferred need not be complete or permanent, as long as the benefits of administering the immunogenic polypeptide outweigh any disadvantages thereof. Subjects and immunogens are as described above.

Dosages of the virus vectors to be administered to a subject will depend upon the mode of administration, the disease or condition to be treated, the individual subject's condition, the particular virus vector, and the nucleic acid to be delivered, and can be determined in a routine manner. Exemplary doses for achieving therapeutic effects are virus titers of at least about $10^5$, $10^6$, $10^7$, $10^8$, $10^9$, $10^{10}$, $10^{11}$, $10^{12}$, $10^3$, $10^{14}$, $10^{15}$ transducing units or more, preferably about $10^7$ or $10^8$-$10^{12}$, $10^{13}$ or $10^{14}$ transducing units, yet more preferably about $10^{12}$ transducing units.

In particular embodiments, more than one administration (e.g., two, three, four or more administrations) may be employed to achieve the desired level of gene expression over a period of various intervals, e.g., daily, weekly, monthly, yearly, etc.

Exemplary modes of administration include oral, rectal, transmucosal, topical, intranasal, inhalation (e.g., via an aerosol), buccal (e.g., sublingual), vaginal, intrathecal, intraocular, transdermal, in utero (or in ovo), parenteral (e.g., intravenous, subcutaneous, intradermal, intramuscular [including administration to skeletal, diaphragm and/or cardiac muscle], intradermal, intrapleural, intracerebral, and intraarticular), topical (e.g., to both skin and mucosal surfaces, including airway surfaces, and transdermal administration), intro-lymphatic, and the like, as well as direct tissue or organ injection (e.g., to liver, skeletal muscle, cardiac muscle, diaphragm muscle or brain). Administration can also be to a tumor (e.g., in or a near a tumor or a lymph node). The most suitable route in any given case will depend on the nature and severity of the condition being treated and on the nature of the particular vector that is being used.

Administration to skeletal muscle according to the present invention includes but is not limited to administration to skeletal muscles in the limbs (e.g., upper arm, lower arm, upper leg, and/or lower leg), back, neck, head (e.g., tongue), thorax, abdomen, pelvis/perineum, and/or digits. Suitable skeletal muscle tissues include but are not limited to abductor digiti minimi (in the hand), abductor digiti minimi (in the foot), abductor hallucis, abductor ossis metatarsi quinti, abductor pollicis brevis, abductor pollicis longus, adductor brevis, adductor hallucis, adductor longus, adductor magnus, adductor pollicis, anconeus, anterior scalene, articularis genus, biceps brachii, biceps femoris, brachialis, brachioradialis, buccinator, coracobrachialis, corrugator supercilii, deltoid, depressor anguli oris, depressor labii inferioris, digastric, dorsal interossei (in the hand), dorsal interossei (in the foot), extensor carpi radialis brevis, extensor carpi radialis longus, extensor carpi ulnaris, extensor digiti minimi, extensor digitorum, extensor digitorum brevis, extensor digitorum longus, extensor hallucis brevis, extensor hallucis longus, extensor indicis, extensor pollicis brevis, extensor pollicis longus, flexor carpi radialis, flexor carpi ulnaris, flexor digiti minimi brevis (in the hand), flexor digiti minimi brevis (in the foot), flexor digitorum brevis, flexor digitorum longus, flexor digitorum profundus, flexor digitorum superficialis, flexor hallucis brevis, flexor hallucis longus, flexor pollicis brevis, flexor pollicis longus, frontalis, gastrocnemius, geniohyoid, gluteus maximus, gluteus medius, gluteus minimus, gracilis, iliocostalis cervicis, iliocostalis lumborum, iliocostalis thoracis, illiacus, inferior gemellus, inferior oblique, inferior rectus, infraspinatus, interspinalis, intertransversi, lateral pterygoid, lateral rectus, latissimus dorsi, levator anguli oris, levator labii; superioris, levator labii superioris alaeque nasi, levator palpebrae superioris, levator scapulae, long rotators, longissimus capitis, longissimus cervicis, longissimus thoracis, longus capitis, longus colli, lumbricals (in the hand), lumbricals (in the foot), masseter, medial pterygoid, medial rectus, middle scalene, multifidus, mylohyoid, obliquus capitis inferior, obliquus capitis superior, obturator externus, obturator internus, occipitalis, omohyoid, opponens digiti minimi, opponens pollicis, orbicularis oculi, orbicularis oris, palmar interossei, palmaris brevis, palmaris longus, pectineus, pectoralis major, pectoralis minor, peroneus brevis, peroneus longus, peroneus tertius, piriformis, plantar interossei, plantaris, platysma, popliteus, posterior scalene, pronator quadratus, pronator teres, psoas major, quadratus femoris, quadratus plantae, rectus capitis anterior, rectus capitis lateralis, rectus capitis posterior major, rectus capitis posterior minor, rectus femoris, rhomboid major, rhomboid minor, risorius, sartorius, scalenus minimus, semimembranosus, semispinalis capitis, semispinalis cervicis, semispinalis thoracis, semitendinosus, serratus anterior, short rotators, soleus, spinalis capitis, spinalis cervicis, spinalis thoracis, splenius capitis, splenius cervicis, sternocleidomastoid, sternohyoid, sternothyroid, stylohyoid, subclavius, subscapularis, superior gemellus, superior oblique, superior rectus, supinator, supraspinatus, temporalis, tensor fascia lata, teres major, teres minor, thoracis, thyrohyoid, tibialis anterior, tibialis posterior, trapezius, triceps brachii, vastus intermedius, vastus lateralis, vastus medialis, zygomaticus major, and zygomaticus minor and any other suitable skeletal muscle as known in the art. In particular embodiments, the virus vector comprises, consists of, or consists essentially of the M41 capsid (FIG. 3A-3C) or the H50 capsid (FIG. 3TT-3VV).

The virus vector can be delivered to skeletal muscle by any suitable method including without limitation intravenous administration, intra-arterial administration, intraperitoneal administration, isolated limb perfusion (of leg and/or arm; see, e.g. Arruda et al., (2005) *Blood* 105: 3458-3464), and/or direct intramuscular injection.

Administration to cardiac muscle includes without limitation administration to the left atrium, right atrium, left ventricle, right ventricle and/or septum. The virus vector can be delivered to cardiac muscle by any method known in the art including, e.g., intravenous administration, intra-arterial administration such as intra-aortic administration, direct cardiac injection (e.g., into left atrium, right atrium, left ventricle, right ventricle), and/or coronary artery perfusion. In particular embodiments, the virus vector comprises, consists of, or consists essentially of the M41 capsid (FIG. 3A-3C) or the H50 capsid (FIG. 3TT-3VV).

Administration to diaphragm muscle can be by any suitable method including intravenous administration, infra-arterial administration, and/or intra-peritoneal administration. In particular embodiments, the virus vector comprises, consists of, or consists essentially of the M41 capsid (FIG. 3A-3C) or the H50 capsid (FIG. 3TT-3VV).

Delivery to any of these tissues can also be achieved by delivering a depot comprising the virus vector, which can be implanted into the skeletal, cardiac and/or diaphragm muscle tissue or the tissue can be contacted with a film or other matrix comprising the virus vector. Examples of such implantable matrices or substrates are described in U.S. Pat. No. 7,201, 898).

In particular embodiments, a virus vector according to the present invention is administered to skeletal muscle, diaphragm muscle and/or cardiac muscle (e.g., to treat muscular dystrophy, heart disease [for example, PAD or congestive heart failure]). Optionally, the virus vector comprises, consists of, or consists essentially of the M41 capsid (FIG. 3A-3C) or the H50 capsid (FIG. 3TT-3VV).

The invention can be used to treat disorders of skeletal, cardiac and/or diaphragm muscle. Alternatively, the invention can be practiced to deliver a nucleic acid to skeletal, cardiac and/or diaphragm muscle, which is used as a platform for production of a protein product (e.g., an enzyme) or non-translated RNA (e.g., RNAi, microRNA, antisense RNA) that normally circulates in the blood or for systemic delivery to other tissues to treat a disorder (e.g., a metabolic disorder, such as diabetes (e.g., insulin), hemophilia (e.g., Factor IX or Factor VIII), or a lysosomal storage disorder (such as Gaucher's disease [glucocerebrosidase], Pompe disease [lysosomal acid α-glucosidase] or Fabry disease [α-galactosidase A]) or a glycogen storage disorder (such as Pompe disease [lysosomal acid α glucosidase]). Other suitable proteins for treating metabolic disorders are described above.

In a representative embodiment, the invention provides a method of treating muscular dystrophy in a subject in need thereof, the method comprising: administering an effective amount of a virus vector of the invention to a mammalian subject, wherein the virus vector comprises a heterologous nucleic acid effective to treat muscular dystrophy. In an exemplary embodiment, the method comprises: administering an effective amount of a virus vector of the invention to a mammalian subject, wherein the virus vector comprises a heterologous nucleic acid encoding dystrophin, a mini-dystrophin, a micro-dystrophin, utrophin, mini-utrophin, laminin-α2, mini-agrin, Fukutin-related protein, follistatin, dominant negative myostatin, α-sarcoglycan, β-sarcoglycan, γ-sarcoglycan, δ-sarcoglycan, IGF-1, myostatin pro-peptide, activin type II soluble receptor, anti-inflammatory polypeptides such as the Ikappa B dominant mutant, sarcospan, antibodies or antibody fragments against myostatin or myostatin propeptide, or inhibitory RNA (e.g., antisense RNA, microRNA or RNAi) against myostatin, mir-1, mir-133, mir-206, mir-208 or an inhibitory RNA (e.g., microRNA, RNAi or antisense RNA) to induce exon skipping in a defective dystrophin gene. In particular embodiments, the virus vector can be administered to skeletal, diaphragm and/or cardiac muscle as described elsewhere herein. Optionally, the virus vector comprises, consists of, or consists essentially of the M41 capsid (FIG. 3A-3C) or the H50 capsid (FIG. 3TT-3VV).

The invention further encompasses a method of treating a metabolic disorder in a subject in need thereof. In representative embodiments, the method comprises: administering an effective amount of a virus vector of the invention to skeletal muscle of a subject, wherein the virus vector comprises a heterologous nucleic acid encoding a polypeptide, wherein the metabolic disorder is a result of a deficiency and/or defect in the polypeptide. Illustrative metabolic disorders and heterologous nucleic acids encoding polypeptides are described herein. Optionally, the virus vector comprises, consists of, or consists essentially of the M41 capsid (FIG. 3A-3C) or the H50 capsid (FIG. 3TT-3VV). As a further option, the heterologous nucleic acid can encode a secreted protein.

The invention can also be practiced to produce inhibitory RNA (e.g., antisense RNA, microRNA or RNAi) for systemic delivery.

The invention also provides a method of treating congenital heart failure in a subject in need thereof, the method comprising administering an effective amount of a virus vector of the invention to a mammalian subject, wherein the virus vector comprises a heterologous nucleic acid effective to treat congenital heart failure. In representative embodiments, the method comprises administering an effective amount of a virus vector of the invention to a mammalian subject, wherein the virus vector comprises a heterologous nucleic acid encoding a sarcoplasmic endoreticulum $Ca^{2+}$-ATPase (SERCA2a), an angiogenic factor, phospholamban, PI3 kinase, calsarcan, a β-adrenergic receptor kinase (βARK), βARKct, inhibitor 1 of protein phosphatase 1, Pim-1, PGC-1α, SOD-1, SOD-2, EC-SOD, Kallikrein, HIF, thymosin-β4, S100A1, parvalbumin, adenylyl cyclase type 6, a molecule that effects G-protein coupled receptor kinase type 2 knockdown such as a truncated constitutively active bARKct; phospholamban inhibitory or dominant-negative molecules such as phospholamban S16E, mir-1, mir-133, mir-206, mir-208. Optionally, the virus vector comprises, consists of, or consists essentially of the M41 capsid (FIG. 3A-3C) or the H50 capsid (FIG. 3TT-3VV).

Injectables can be prepared in conventional forms, either as liquid solutions or suspensions, solid forms suitable for solution or suspension in liquid prior to injection, or as emulsions. Alternatively, one may administer the virus vector in a local rather than systemic manner, for example, in a depot or sustained-release formulation. Further, the virus vector can be delivered dried to a surgically implantable matrix such as a bone graft substitute, a suture, a stent, and the like (e.g., as described in U.S. Pat. No. 7,201,898).

Pharmaceutical compositions suitable for oral administration can be presented in discrete units, such as capsules, cachets, lozenges, or tablets, each containing a predetermined amount of the composition of this invention; as a powder or granules; as a solution or a suspension in an aqueous or non-aqueous liquid; or as an oil-in-water or water-in-oil emulsion. Oral delivery can be performed by complexing a virus vector of the present invention to a carrier capable of withstanding degradation by digestive enzymes in the gut of an animal. Examples of such carriers include plastic capsules or tablets, as known in the art. Such formulations are prepared by any suitable method of pharmacy, which includes the step of bringing into association the composition and a suitable carrier (which may contain one or more accessory ingredients as noted above). In general, the pharmaceutical composition according to embodiments of the present invention are prepared by uniformly and intimately admixing the composition with a liquid or finely divided solid carrier, or both, and then, if necessary, shaping the resulting mixture. For example, a tablet can be prepared by compressing or molding a powder or granules containing the composition, optionally with one or more accessory ingredients. Compressed tablets are prepared by compressing, in a suitable machine, the composition in a free-flowing form, such as a powder or granules optionally mixed with a binder, lubricant, inert diluent, and/or surface active/dispersing agent(s). Molded tablets are made by molding, in a suitable machine, the powdered compound moistened with an inert liquid binder.

Pharmaceutical compositions suitable for buccal (sub-lingual) administration include lozenges comprising the composition of this invention in a flavored base, usually sucrose and acacia or tragacanth; and pastilles comprising the composition in an inert base such as gelatin and glycerin or sucrose and acacia.

Pharmaceutical compositions suitable for parenteral administration can comprise sterile aqueous and non-aqueous injection solutions of the composition of this invention, which preparations are optionally isotonic with the blood of the intended recipient. These preparations can contain antioxidants, buffers, bacteriostats and solutes, which render the composition isotonic with the blood of the intended recipient. Aqueous and non-aqueous sterile suspensions, solutions and emulsions can include suspending agents and thickening agents. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, antioxidants, chelating agents, and inert gases and the like.

The compositions can be presented in unit\dose or multi-dose containers, for example, in sealed ampoules and vials, and can be stored in a freeze-dried (lyophilized) condition requiring only the addition of the sterile liquid carrier, for example, saline or water-for-injection immediately prior to use.

Extemporaneous injection solutions and suspensions can be prepared from sterile powders, granules and tablets of the kind previously described. For example, an injectable, stable, sterile composition of this invention in a unit dosage form in a sealed container can be provided. The composition can be provided in the form of a lyophilizate, which can be reconstituted with a suitable pharmaceutically acceptable carrier to form a liquid composition suitable for injection into a subject. The unit dosage form can be from about 1 μg to about 10 grams of the composition of this invention. When the composition is substantially water-insoluble, a sufficient amount of emulsifying agent, which is physiologically acceptable, can be included in sufficient quantity to emulsify the composition in an aqueous carrier. One such useful emulsifying agent is phosphatidyl choline.

Pharmaceutical compositions suitable for rectal administration can be presented as unit dose suppositories. These can be prepared by admixing the composition with one or more conventional solid carriers, such as for example, cocoa butter and then shaping the resulting mixture.

Pharmaceutical compositions of this invention suitable for topical application to the skin can take the form of an ointment, cream, lotion, paste, gel, spray, aerosol, or oil. Carriers that can be used include, but are not limited to, petroleum jelly, lanoline, polyethylene glycols, alcohols, transdermal enhancers, and combinations of two or more thereof. In some embodiments, for example, topical delivery can be performed by mixing a pharmaceutical composition of the present invention with a lipophilic reagent (e.g., DMSO) that is capable of passing into the skin.

Pharmaceutical compositions suitable for transdermal administration can be in the form of discrete patches adapted to remain in intimate contact with the epidermis of the subject for a prolonged period of time. Compositions suitable for transdermal administration can also be delivered by iontophoresis (see, for example, *Pharmaceutical Research* 3:318 (1986)) and typically take the form of an optionally buffered aqueous solution of the composition of this invention. Suitable formulations can comprise citrate or bis\tris buffer (pH 6) or ethanol/water and can contain from 0.1 to 0.2M active ingredient.

The virus vectors disclosed herein may be administered to the lungs of a subject by any suitable means, for example, by administering an aerosol suspension of respirable particles comprised of the virus vectors, which the subject inhales. The respirable particles may be liquid or solid. Aerosols of liquid particles comprising the virus vectors may be produced by any suitable means, such as with a pressure-driven aerosol nebulizer or an ultrasonic nebulizer, as is known to those of skill in the art. See, e.g., U.S. Pat. No. 4,501,729. Aerosols of solid particles comprising the virus vectors may likewise be produced with any solid particulate medicament aerosol generator, by techniques known in the pharmaceutical art.

III. DIRECTED EVOLUTION AND IN VIVO PANNING FOR VIRUS VECTORS COMPRISING SCRAMBLED AAV CAPSIDS

The present invention also encompasses novel methods for creating a pool of viruses comprising scrambled AAV capsids (e.g., AAV particles comprising the scrambled AAV capsids) and then selecting in vivo for scrambled capsids/viruses having one or more desired characteristics. Non-limiting examples of such characteristics include tropism profile, the ability to evade neutralizing antibodies, and improved intracellular trafficking.

In a representative embodiment, the invention provides a method of identifying a virus vector (e.g., an AAV vector) or AAV capsid having a tropism profile of interest, the method comprising (a) providing a collection of virus vectors (e.g., AAV particles), wherein each AAV vector within the collection comprises: (i) an AAV capsid comprising, consisting of, or consisting essentially of capsid proteins generated by scrambling the capsid coding sequences of two or more different AAV, wherein the capsid amino acid sequences of the two or more different AAV differ by at least two amino acids; and (ii) a viral vector genome (e.g., an AAV vector genome) comprising: an AAV cap coding sequence encoding the AAV capsid of (i); an AAV rep coding sequence; and at least one terminal repeat (e.g., a 5' and/or 3' terminal repeat such as, for example, and AAV 5' and/or 3' terminal repeat) that functions with the Rep protein(s) encoded by the AAV rep coding sequence; wherein the AAV capsid encapsidates the vector genome; (b) administering the collection of virus vectors to a subject; (c) recovering a plurality of virus vectors as virions or as viral vector genomes each encoding an AAV capsid from a target tissue, thereby identifying a virus vector or AAV capsid having a tropism of interest.

The invention can also be practiced to identify in vivo a scrambled AAV capsid or virus particle comprising the same having the ability to evade neutralizing antibodies (e.g., neutralizing antibodies found in human serum). For example, in vivo screening for resistance to neutralizing antibodies can be carried out by injecting human IgGs (e.g., IVIG; a pool of human IgGs) into a subject (e.g., a non-human mammalian subject). The IVIG naturally contains a mixture of antibodies against all of the common AAVs seen by the human population. Alternatively, specific neutralizing antibody(ies) can be administered to the subject. The scrambled virus library is then injected into the subject and selection is carried out for viral genomes that enter the target tissue(s) of interest (e.g., heart, skeletal muscle, liver, etc). Those genomes that are isolated from the target tissue correspond to those capsids that are able to evade neutralization.

Thus, in representative embodiments, the invention provides a method of identifying a scrambled AAV capsid or virus vector (e.g., an AAV vector) comprising the same having the ability to evade neutralizing IgGs (e.g., neutralizing human IgGs), the method comprising (a) administering a pool of IgGs (e.g., human IgGs) to a mammalian subject; (b) providing a collection of scrambled virus vectors (e.g., scrambled AAV vectors), wherein each virus vector within the collection comprises: (i) an AAV capsid comprising a capsid protein generated by scrambling the capsid sequences of two or more different AAV, wherein the capsid amino acid sequences of the two or more different AAV differ by at least two amino acids; and (ii) a viral vector genome (e.g., an AAV vector genome) comprising: a cap coding sequence encoding the AAV capsid of (i); an AAV rep coding sequence; and at least one terminal repeat (e.g., a 5' and/or 3' terminal repeat such as for example, a 5' and/or 3' AAV terminal repeat) that functions with the Rep protein(s) encoded by the AAV rep coding sequence; wherein the AAV capsid encapsidates the virus vector genome; (c) administering the collection of virus vectors to a subject; (d) recovering a plurality of virus vectors as virions or as viral vector genomes each encoding an AAV capsid from a target tissue, thereby identifying a virus vector or AAV capsid having the ability to evade neutralizing IgGs (e.g., neutralizing human IgGs). In particular embodiments, the pool of IgGs are an IVIG preparation.

By "evade" neutralizing antibodies, it is intended that there is at least a partial reduction in neutralization as compared with a suitable control (e.g., a naturally occurring AAV such as AAV2, AAV8 or AAV9), but the degree of evasion or "resistance" need not be complete as long as there is some reduction in neutralization as compared with the control and as long as some of the vector is able to reach and transduce the target tissue.

In particular embodiments, the target tissue is skeletal muscle (as described above), liver, cardiac muscle, diaphragm muscle, kidney, liver, pancreas, spleen, the gastrointestinal tract, lung, joint tissue, tongue, ovary, testis, germ cells, cancer cells, or a combination of the foregoing.

The sequences of any combination of two or more AAV capsids, whether naturally-occurring or modified and whether now known or later discovered can be "scrambled" or "shuffled" to create a collection of AAV vectors comprising the scrambled capsids. In representative embodiments, the collection of AAV vectors comprises capsids generated by scrambling capsid sequences from two or more of the following: AAV1, AAV2, AAV3A, AAV3B, AAV4, AAV5, AAV6, AAV7, AAV8, AAV9, AAV10, AAV11, AAV12, avian AAV, bovine AAV, canine AAV, equine AAV, ovine AAV, goose AAV or snake AAV. As noted above, the collection of AAV capsids can further comprise non-naturally occurring AAV capsids, now known or later discovered. Such modifications include substitutions including substitutions of modified nucleic acids and/or amino acids, and deletions including truncations and/or insertions (including peptide display).

Further diversity among the scrambled capsids can be achieved by any method known in the art for introducing mutations into nucleic acid and/or amino acid sequences, e.g., using chemical mutagens, error-prone PCR, cassette mutagenesis, and the like.

In particular embodiments, the method is carried out as an iterative process, e.g., steps (a) through (c) are carried out for two or more iterative cycles. For example, one or more of the scrambled AAV capsid sequences identified in the first round of in vivo screening can be used as a starting point to create a second (or subsequent) collection of scrambled AAV capsids for in vivo selection.

Optionally, the in vivo selection methods can be combined with one or more rounds of in vitro selection to further optimize the vectors. For example, in vivo selection can be carried out to identify scrambled AAV capsids having a desired tropism profile and then in vitro selection can be used to identify those scrambled AAV capsids having the ability to evade neutralization by antibodies (e.g., serum antibodies found in the human population).

The collection of AAV particles can be administered to the subject by any suitable method. In particular embodiments, the collection is administered into the blood stream of the subject (e.g., intravenous or intra-articular).

Modes of administration and subjects are as described elsewhere herein.

The invention can be used to identify scrambled viruses or virus capsids having a desired tropism pattern or profile in vivo in a subject. Accordingly, in particular embodiments, the inventive methods comprise recovering AAV particles or viral genomes encoding the same from two or more target tissues and identifying scrambled viruses or scrambled AAV capsids having a desired tropism for the two or more target tissues. For example, in particular embodiments, a scrambled virus or scrambled AAV capsid having efficient tropism for skeletal muscle, diaphragm muscle and/or cardiac muscle and inefficient tropism for liver, gonads and/or stem cells is identified.

The target cell or tissue (or one of the target cells/tissues) can also be a cancer cell or tumor tissue. For example, the scrambled virus can be administered to an animal model of cancer and scrambled virus particles or viral genomes encoding the same are isolated from cancer cells or tumor. In representative embodiments, the animal model can be one that has an increased likelihood of forming cancers or tumors or can be a xenograft model in which human tumor cells are grafted into the animal.

Exemplary methods of DNA "scrambling, also called "shuffling," "molecular breeding," "fast forced evolution" and the like are known in the art. See, e.g., U.S. Pat. No. 5,605,793; U.S. Pat. No. 6,165,793; U.S. Pat. No. 5,605,793; U.S. Pat. No. 6,117,679; Stemmer, (1994) *Proc. Natl. Acad. Sci.* 91:10747-10751; and Soong et al., (2000) *Nature Genetics* 25:436-439. Such methods have also been applied to directed evolution of viruses. See, e.g., U.S. Pat. No. 6,096, 548 and U.S. Pat. No. 6,596,539. In a representative embodiment, a collection of AAV capsid protein coding sequences (or portions thereof) are fragmented and recombined in vitro by homologous and/or non-homologous recombination to create a collection of "scrambled" AAV capsid proteins. Scrambled virus is generated in which each scrambled capsid packages a nucleic acid (e.g., an AAV genome) comprising the corresponding capsid coding sequence (i.e., encoding the capsid protein of the virus). The collection of scrambled viruses is administered to a subject and in vivo selection is carried out for a characteristic of interest. For example, scrambled virus can be isolated from one or more target tissues to identify those optimized capsid proteins having a desired tropism profile. The method can be carried out in iterative cycles to further optimize the capsid sequences.

Having described the present invention, the same will be explained in greater detail in the following examples, which are included herein for illustration purposes only, and which are not intended to be limiting to the invention.

EXAMPLES

The Examples below describe the modification of the AAV capsid gene by directed evolution to generate an optimized vector for systemic gene delivery to heart and skeletal muscle. DNA shuffling was used to modify the AAV capsid gene and an AAV library was constructed for screening against a mouse model. AAV variants enriched in mouse heart and skeletal muscle were isolated and characterized based on their tropism and neutralization properties. In general, this approach mimics the natural evolution of a virus in an animal model.

Example 1

Materials & Methods

Generation of Chimeric AAV Library with Shuffled Capsid Genes

For construction of random chimeric AAV capsid gene libraries, AAV serotypes 1, 2, 3B, 4, 6, 7, 8, 9 were used as PCR templates. The capsid genes were amplified by primers CAP-5' (5'-CCC-AAGCTTCGATCAACTACGCAGACAG-GTACCAA-3'; SEQ ID NO:139) and CAP-3' (5'-ATAA-GAAT-GCGGCCGC-AGAGACCAAAGTTCAACT-GAAACGA-3'; SEQ ID NO:140) and mixed in equal ratio for DNA shuffling (Soong et al., (2000) *Nat Genet.* 25: 436-9). In brief, 4 µg of the DNA templates were treated by 0.04 U of DNase I at 15° C. briefly. DNA fragments in size of 300-1000 bp were purified by agarose gel electrophoresis, denatured, re-annealed and repaired by pfu DNA polymerase to reassemble random capsid genes. Amplification was done by use of pfu DNA polymerase and CAP5'/CAP3' primers. The PCR program was 30 cycles of 94° C. 1 min, 60° C. 1 min and 72° C. 4.5 min. The PCR products were then digested with Hind III and Not I and ligated into a Hind III and Not I digested plasmid backbone containing AAV2 Rep gene and inverted terminal repeats. The random infectious plasmids library was obtained by transforming the above ligated DNA into DH10B *E. coli* cells. Random clones were picked for restriction enzyme analysis and replication and packaging viability in 293 cells. The shuffled infectious AAV library was finally produced using a self-packaging technique developed by Muller et al. (*Nature Biotechnol.* (2003) 21:1040-1046).

In Vivo Biopanning of Mutant AAV Capsid Library in Mice

A dose of $5 \times 10^{11}$ vector genomes of the chimeric AAV library were injected into adult C57BL/6J mice via tail vein. Three days later, mice were sacrificed and perfused with PBS to remove the blood from tissues. The hind limb skeletal muscles and liver were collected for total DNA isolation. The capsid genes enriched in the muscle were retrieved by PCR amplification using primers Cap 5' and Cap 3' and the iProof DNA polymerase (Bio-Rad). The PCR products were digested with Hind III and Not I and cloned similarly as described in previous section. The 43 representative AAV capsid genotypes were identified from the reconstructed plasmid library by restriction analysis and mixed in equal ratio for production of a secondary AAV library as described earlier. This AAV library was again injected i.v. in mice for secondary screening and retrieval from muscle and liver. Random colonies were sequenced and compared for their tissue distribution.

Sequence and Structure Analyses of Modified AAV Capsid Genes

Identification and alignment of the capsid genes from the mouse tissues was done using Clustal X (Larkin et al. (2007) Clustal w and clustal x version 2.0. *Bioinformatics* 23: 2947-8).

Tissue Tropism of AAV Vectors in Mice after Systemic Administration

The M41 capsid gene was used to package CMV-luciferase, CB-LacZ or CMV-LacZ reporter vectors for comparison with the AAV9 or AAV6 packaged ones. $3 \times 10^{11}$ v.g. of reporter vectors containing CMV-luciferase or CB-LacZ genes were injected i.v. in 6 to 8-week-old C57BU6J mice for systemic gene delivery and expression. The heart, skeletal muscle and main internal organs of mice were collected 2-weeks later. Reporter gene expression was monitored by luciferase assay (Luciferase Assay System; Promega) or β-gal assay (Galacto-Light Plus™ system; Applied Biosystems). Cryosectioning and X-gal staining were used to visualize cell that expressed the LacZ in the heart and muscle. Total DNA was extracted from mouse tissues for quantitative detection of vector genome copies by Taqman probes (Applied Biosystems) with a single-copy endogenous gene (glucagon gene) as the diploid cell number reference.

Transduction of Primary Cardiomyocytes or Skeletal Muscle by AAV Vectors

Rat neonatal cardiomyocytes were isolated and cultured as previously reported. 24 hr after pre-plating, rAAV9-, rM41- or rAAV6-CMV-lacZ vectors were inoculated onto the cardiomyocytes in infection multiplicity of 3000. Cells were fixed for X-gal staining or β-gal assay after another 96 hr to detect transgene expression. For skeletal muscle transduction, 50 µL of virus dilutes containing $5 \times 10 \sim 9$ v.g. of rAAV vectors were intramuscularly injected into gastrocnemius muscles of adult 7-week-old C57BJ/6L mice. 14 days later muscle tissues were collected for detection of transgene expression by X-gal staining or β-gal assay. Vector genome distribution in cardiomyocytes or skeletal muscles was quantitated by real-time PCR as described.

Gene Transfer and Functional Assays in the Hamster Models

Tropism of the new vectors in hamsters was first investigated in the normal F1B hamsters. A dose of $10^{12}$ vector genomes of M41-CMV-lacZ or AAV9-CMV-lacZ were administered into 2- to 3-month-old male F1B hamsters via the jugular vein. Three weeks later heart, skeletal muscles and the internal organs including the liver were collected for histological staining. The synthetic muscle-specific promoter (SYN) C5-12 was used to achieve strong and muscle-specific δ-SG transgene expression in the TO-2 hamsters (Zhu et al., (2005) *Circulation* 112: 2650-9). A dose of $10^{12}$ vector genomes of the M41-SYN-δSG vectors were administered into 7-week-old male TO-2 hamsters intravenously with untreated TO-2 or with normal F1B hamsters as the control groups. Three days before and one month after vector administration, blood samples were collected from the hamsters by cardiac puncture. Sera were prepared for the creatine kinase (CK) activity assay (TECO Diagnostics). Four months after vector administration, the hamsters were subject to echocardiography analysis to assess their cardiac and whole-body muscle functions as reported (Zhu et al., (2005) *Circulation* 112: 2650-9). δ-SG expression was detected by immunofluorescence staining or Western blotting (Zhu et al., (2005) *Circulation* 112: 2650-9). H&E, Masson's trichrome and Von Kossa stainings of the heart tissues were used for histology, fibrosis and calcification respectively (Zhu et al., (2005) *Circulation* 112: 2650-9).

Example 2

Direct In Vivo Panning of DNA-Shuffled AAV Library for Muscle-Targeting Capsids We constructed a chimeric AAV library by DNA shuffling of the capsid genes of AAV1, 2, 3, 4, 6, 7, 8 and 9, in order to select for combinations of characteristics. The infectious AAV library with shuffled capsid genes was packaged by the method of Muller et al. (*Nature Biotechnol.* (2003) 21:1040-1046). DNA analysis by restriction digestions on randomly picked mutant AAV clones showed unique patterns and indicated that the vast majority were recombinants and viable in producing AAV particles (FIG. 1).

Although it is known to use in vitro cell culture systems to screen for desirable mutant AAVs, here we solely relied on a direct in vivo screening method, because no cell culture system could simultaneously mimic the in vivo conditions (e.g., the tight endothelial lining, the differentiated muscle cells and the liver, etc.). We used adult mice for in vivo biopanning of the AAV library. Following tail vein injection of a dose of $5\times10^{11}$ v.g. (viral genomes), the AAV cap genes that were enriched in the muscles were retrieved by PCR amplification. In the first round of in vivo screening, 43 distinct AAV clones were identified. They were mixed in equal ratio for secondary AAV library production and second-round in vivo screening. The clones enriched in skeletal muscle but scarce in the liver were further characterized.

A clone named M41 appeared 12 times in 79 randomly picked clones from the skeletal muscle pool but was absent in the liver pool (FIG. 2). Sequence alignment of its capsid amino acid sequence showed that it is a recombinant of four parental AAV serotypes, AAV1, 6, 7 and 8, with segments from AAV1, 8, and 7 in the N-terminal half of the capsid and AAV6, 1 and 6 in the C-terminal half (FIG. 3A). The sequence of the M41 capsid gene and amino acid sequence are depicted in FIGS. 3B and 3C, respectively. The phylogenetic map, capsid coding and amino acid sequences of other AAV mutants isolated from skeletal muscle and heart libraries are depicted in FIGS. 3D-3EEE.

Example 3

M41 Vector Preferentially Transduces Myocardium after Systemic Administration

Figure 4B:
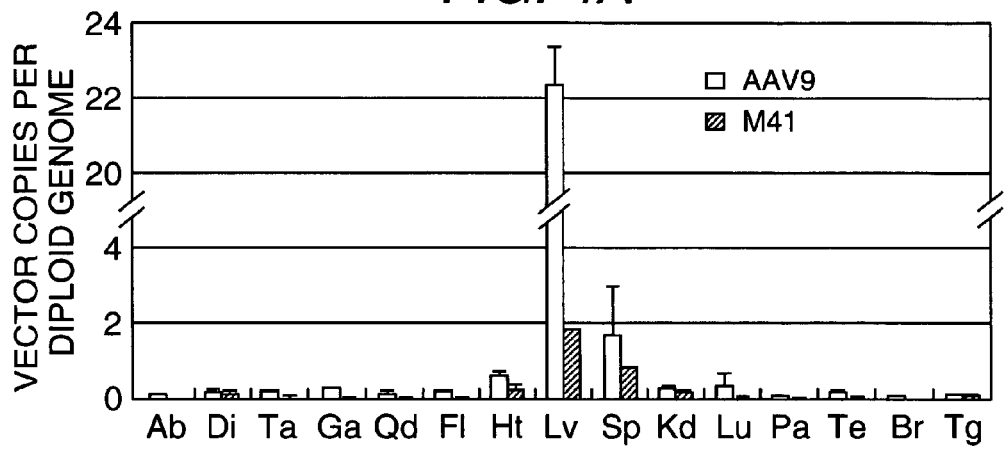

We next investigated systemic gene delivery efficiency and tissue tropism of AAVM41. The luciferase reporter gene was packaged into viral capsids of M41, AAV9, and AAV6 for a side-by-side comparison in vivo. At 2 weeks post i.v. injection in young adult C57BJ/6L mice (6-8 wk), luciferase activities and vector DNA copy numbers in various tissues were analyzed. Consistent with previous reports (Inagaki et al. (2006) *Mol Ther* 14: 45-53), the AAV9 vector efficiently transduced mouse heart, skeletal muscles, and particularly the liver, which had the highest luciferase activity (FIG. 4A) and vector DNA copy numbers (FIG. 4B). Similar to AAV9, the M41 vector also transduced the heart efficiently with slightly lower luciferase activity and vector copy numbers (FIG. 4B). In contrast, M41 showed dramatically reduced gene transfer in the liver, with the luciferase activity 81.1 fold lower and DNA copy number 11.3 fold lower than AAV9. However, AAVM41 gene transfer in the skeletal muscles, except in the tongue, was also significantly lower than AAV9 (FIG. 4A). Interestingly, although the liver had higher DNA copy numbers (FIG. 4B), the heart showed the highest luciferase activity among all tissues examined in M41 injected mice (FIG. 4A), suggesting differential intracellular trafficking and uncoating processes of AAVM41 in these two tissues.

Figure 4C:
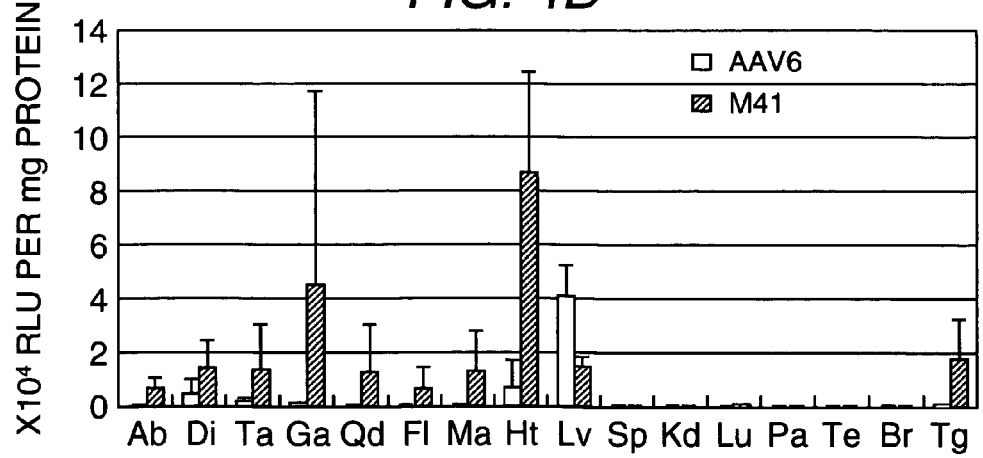
Figure 4D:
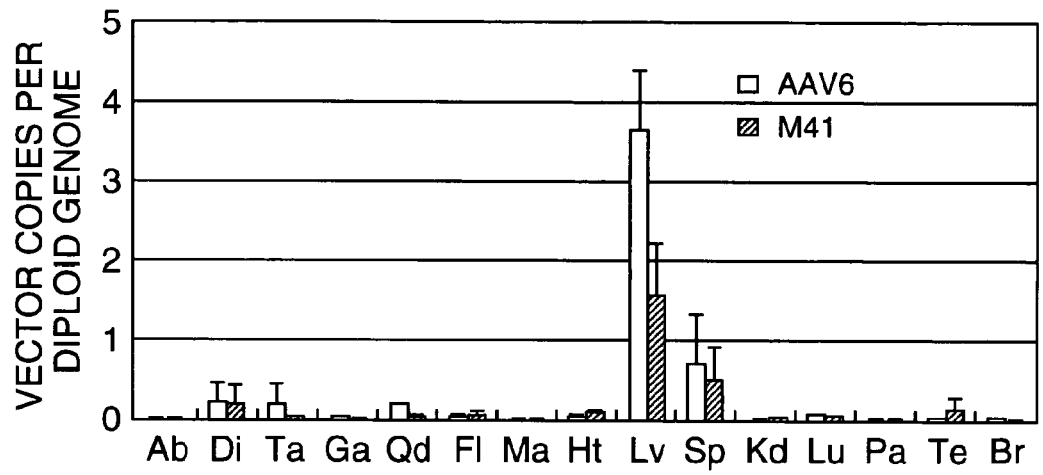

Similar side-by-side comparison between AAVM41 and AAV6 at 2 weeks after i.v. injection revealed higher gene transfer by AAVM41 in all skeletal muscles, and dramatically higher gene transfer (>13 fold) in the heart (FIG. 4C), but more than 50% reduction in the liver. Interestingly, although AAV6 had significantly higher vector DNA copy numbers than AAVM41 in some muscle tissues such as the tibialis anterior and quadriceps (Ta and Qd in FIG. 4D), the gene expression levels were much lower. The inconsistency in vector genome quantity and transgene expression between these two viruses suggests a more complex difference in vector bioavailability in the muscle tissues, such as transcytosis through endothelial lining and preferential infection of muscle rather than non-muscle cells.

Figure 4E:
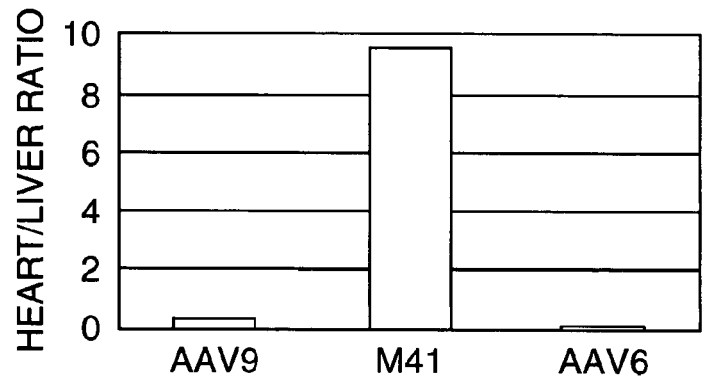
Figure 4F:
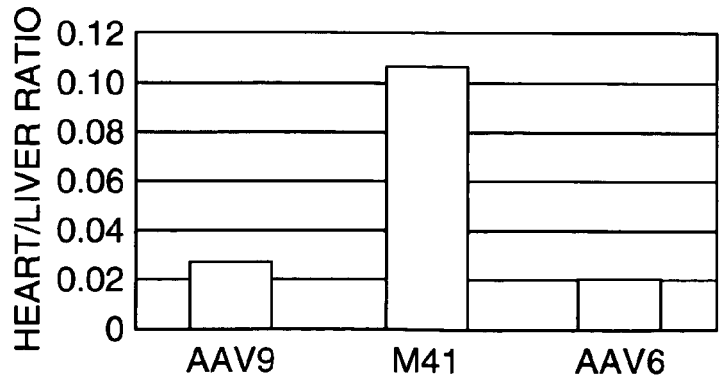

Since one aim of this study was to reduce liver infectivity, we compared ratios of heart vs. liver gene expression for the above three AAVs. While the heart vs. liver ratio of AAVM41 was greater than 10:1, this ratio was reversed to 1:3 in AAV9 and 1:6 in AAV6 (FIG. 4E). Consistently, the ratios of heart vs. liver vector DNA copy numbers also showed a similar trend to the luciferase activities among the three AAVs (FIG. 4F). These data thus demonstrated improved tropism to the heart and much reduced tropism to the liver by AAVM41.

Figure 5A:
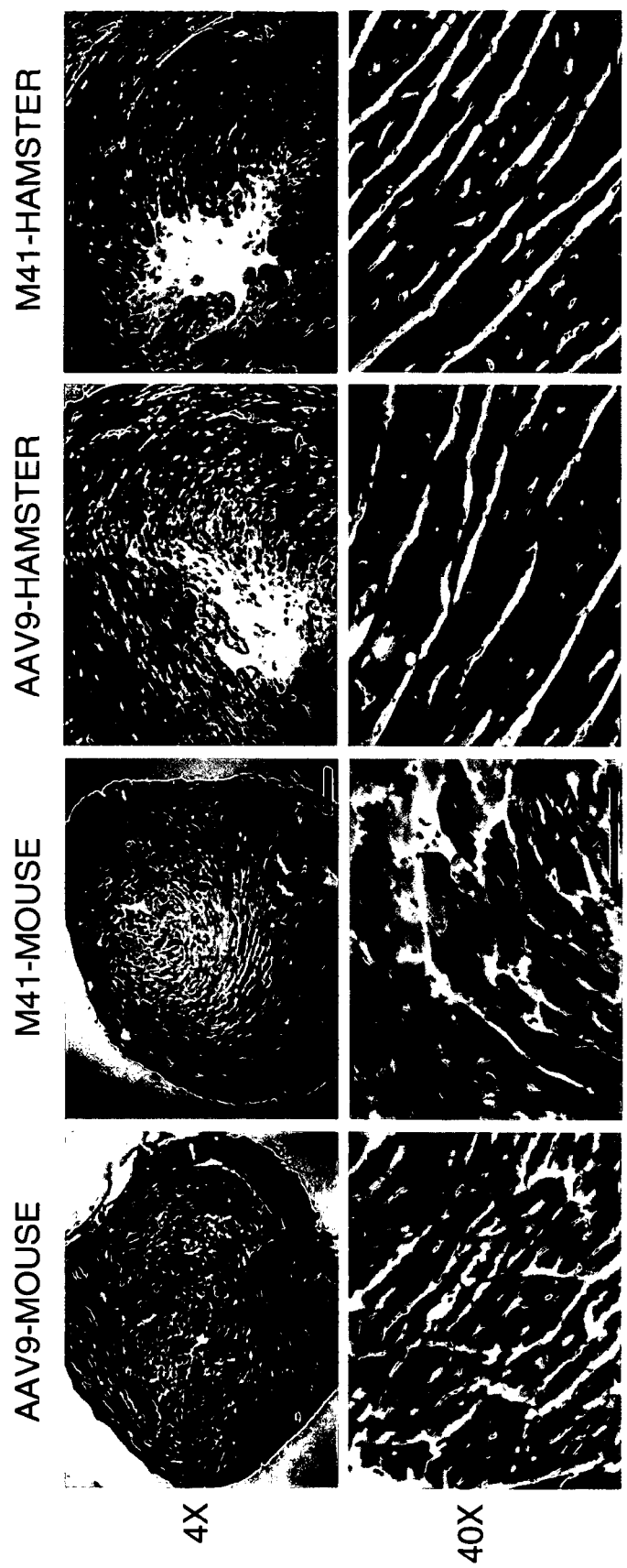
(FIG. 5A) X-gal staining of cross-sections of hearts after systemic administration of AAV vectors. $3 \times 10^{11}$ vector genomes of AAV9- or M41-CB-LacZ were injected via tail vein into adult mice; and $1 \times 10^{12}$ vector genomes of AAV9- or M41-CMV-LacZ were injected via jugular vein into adult hamsters. Hearts from mice or hamsters were collected at 2-weeks or 3-weeks post injection for X-gal and eosin staining. Two magnifications (4× and 40×) were used for photography.
Figure 5B:
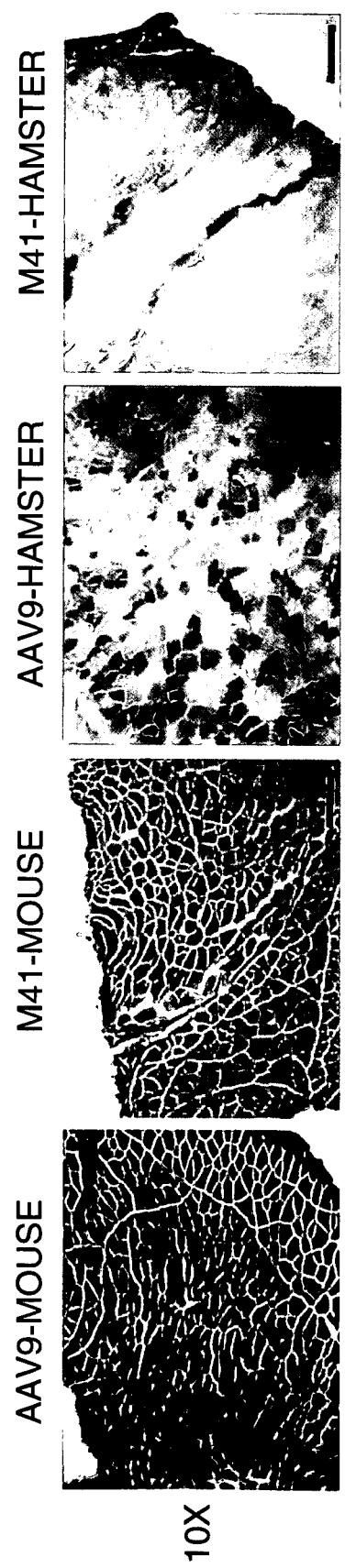
(FIG. 5B) LacZ transgene expression in the tibialis anterior muscles of the same animals as described in (A). Scale bars represented 200 µm (4×) and 50 µm (40×) in (A) and 100 µm in (B).

We next used a β-galactosidase (LacZ) reporter gene to directly visualize transgene expression in cardiomyocytes and myofibers. At 2 weeks post vector i.v. injection in adult C57BJ/6L mice, approximately one half of the cardiomyocytes in the heart showed positive X-gal staining in AAV9- and AAVM41-treated mice (FIG. 5). Similar test was also performed in hamsters, a different and larger species. At 3 weeks post i.v. injection into adult F1B hamsters, nearly 100% of the cardiomyocytes showed positive X-gal staining in both AAV9 and AAVM41 treated groups (FIG. 5). Quantitative enzyme assays showed nearly identical levels of LacZ expression in the hearts of AAV9- and AAVM41-treated mice as well as hamsters (data not shown). In the skeletal muscles of the above mice and hamsters, however, AAVM41 was much less efficient than AAV9 (FIG. 5B). These results are consistent with those of luciferase reporter gene transfer, suggesting preferential targeting of AAVM41 to the myocardium.

Example 4

Additional Iterations of In Vivo Screening

The coding sequences for the AAV capsids described in Example 2 were used as templates for reshuffling. To illustrate, the AAV capsid clones identified by screening heart tissue were reshuffled to generate a secondary heart library. Similarly, a secondary skeletal muscle library was generated from the capsid mutants identified in skeletal muscle. The secondary heart library was subjected to three successive screenings to identify those AAV capsid clones targeting heart ("HH" designation). The secondary skeletal muscle library was used for parallel screening for capsid clones targeting heart (designated "MH") and skeletal muscle (designated "MM"). FIGS. 6A to 6TTTT show the nucleic acid and amino acid sequences of a representative number of AAV capsids identified from these three screens. In general, these particular clones exhibited relatively high frequency in heart or skeletal tissue and relatively low frequency in liver.

Example 5

Direct Infection of Cardiomyocytes and Skeletal Muscle by M41 Vector

Figure 7A:
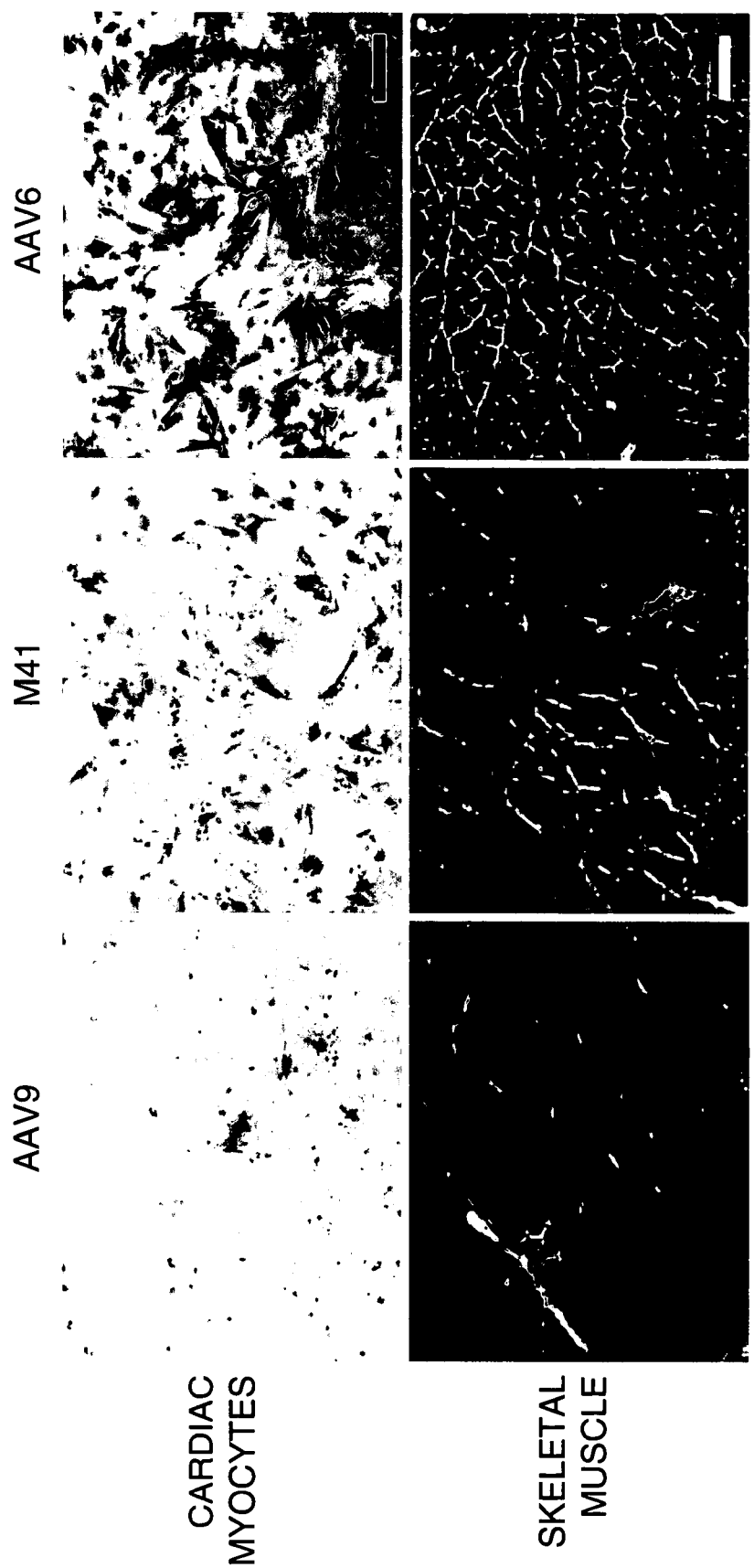
(FIG. 7A) Representative X-gal staining of cardiomyocytes or skeletal muscle after transduction by AAV9-, AAVM41- or AAV6-CMV-LacZ vectors. The AAV vectors were inoculated on the primary neonatal rat cardiomyocytes ($5 \times 10^5$ cells/well) at an infection multiplicity of 3000. Cells were fixed for X-gal staining 96 hrs later (Top panels). The AAV vectors ($5 \times 10^9$ v.g.) were also injected into the gastrocnemius muscle of adult C57BJ/6L mice and tissues were sectioned and stained with X-gal and eosin 14 days post-treatment (bottom panels). Scale bars represent 100 µM.
Figure 7B:
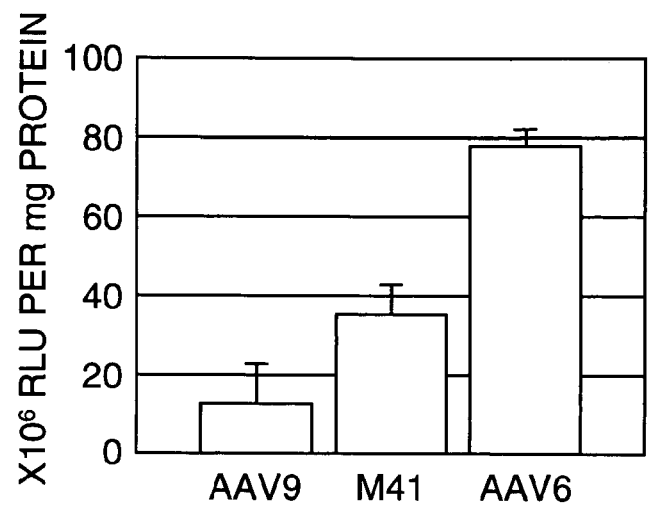
(FIGS. 7B, 7C) Quantitative β-gal activities and AAV vector genome copies in primary cardiomyocytes.

Since AAVM41 was initially isolated from the muscle but showed best infectivity to the heart after systemic delivery, we wished to examine the direct infectivity of AAVM41 on primary cardiomyocyte culture or on skeletal muscles by intramuscular injection. The AAV-LacZ vectors packaged by AAVM41, AAV6 and AAV9 were used to infect primary cardiomyocytes isolated from neonatal rats. Four days later, less than 1% of the AAV9-infected cardiomyocytes expressed the LacZ gene, but approximately 20% or 80% of the M41 or AAV6 cells expressed the LacZ gene (FIG. 7A, top). Quantitative analysis showed that β-gal enzyme activities of AAVM41- or AAV6-infected cardiomyocytes were 2.8- or 6.2-fold of that of AAV9 (FIG. 7B). Similarly, the vector copy numbers in the cells were 2.3- and 10.3-fold of that of AAV9

Figure 7C:
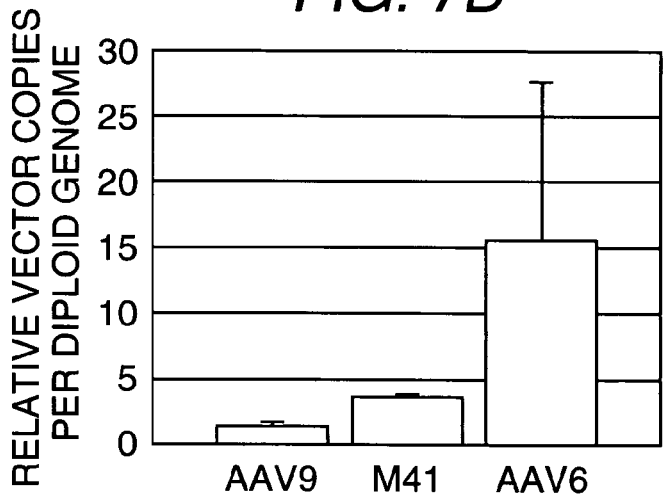

(FIG. 7C). These data indicated that AAVM41 infectivity for cardiomyocytes was higher than AAV9 but lower than AAV6.

Figure 7D:
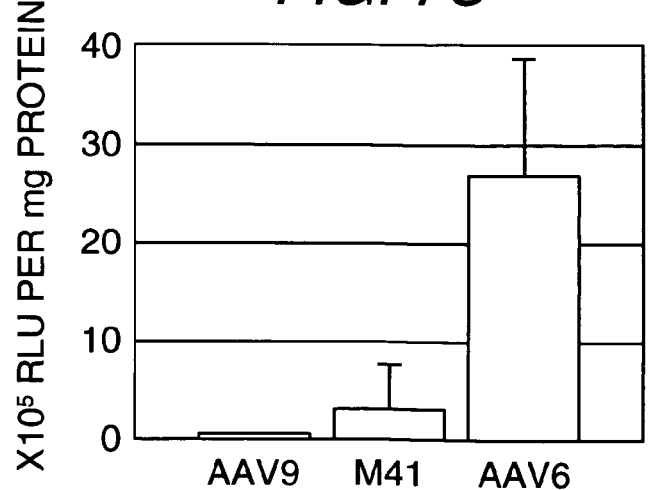
(FIG. 7D) β-gal activities in mouse skeletal muscles. Data are shown as mean values±s.d.

The above three AAV-LacZ vectors were then injected into mouse gastrocnemius muscle for comparison of skeletal muscle infectivities. Two weeks later X-gal staining of the muscle cryosections revealed the strongest expression by AAV6, intermediate expression by AAVM41 and weak expression by AAV9 (FIG. 7A, lower panels). Quantitative β-gal activities of AAV6-injected muscles were 6.1-fold and 53.8-fold of that of AAVM41 and AAV9 respectively (FIG. 7D). Together with the in vitro cardiomyocytes infection data, these results strongly suggest that the much improved systemic muscle and heart gene delivery by AAVM41 over AAV6 is most likely due to improved capability of crossing the tight endothelial barrier and reaching muscle cells.

Example 6

Delivery of δ-Sarcoglycan Gene Via Mutant AAV Vectors

Since AAVM41 showed preferential gene transfer in the heart, we next investigated the utility of this vector for gene therapy in a genetic model of cardiomyopathy, congestive heart failure and muscular dystrophy model, the δ-sarcoglycan (δ-SG) deficient TO-2 hamster. The TO-2 hamster is an animal model with a δ-sarcoglycan gene (δ-SG) deficiency manifesting the limb girdle muscular dystrophy 2F and heart failure (Homburger, et al. (1966) *NY Acad. Sci.* 138:14-27). Systemic gene transfer of δ-SG can effectively ameliorate cardiac and skeletal muscle pathology and profoundly improve function (Zhu, et al. (2005) *Circulation* 112:2650-2659).

Four months after i.v. injection of $1 \times 10^{12}$ v.g. of AAVM41-δ-SG vector, SG expression was detected predominantly in the heart by immunofluorescent (IF) staining (FIG. 8A). Nearly 100% of the cardiomyocytes showed strong and uniform δ-SG expression. However, only 10-30% of the skeletal muscle myofibers expressed δ-SG, as shown in the forelimb, tibialis anterior and tongue muscles. Western blotting confirmed strongest expression of δ-SG in the heart (FIG. 8B). No δ-SG expression was detected in the non-muscle tissues including the liver. The muscle-specific, heart-preferential transgene expression was accompanied by the lack of immune rejection or toxicity throughout the duration of the experiments.

We also evaluated the therapeutic efficacies of AAVM41-δ-SG treatment in the TO-2 hamsters, which manifest both cardiomyopathy and muscular dystrophy. First we measured serum levels of muscle creatine kinase activities and found no statistically significant difference between the treated and untreated groups (data not shown), suggesting insufficient therapeutic gene transfer in the skeletal muscles by AAVM41. This is consistent with the IF staining results (FIG. 8A). We continued to examine the therapeutic efficacy on cardiomyopathy. Upon necropsy, gross examination of the untreated control TO-2 hamster hearts showed markedly dilation and prominent calcification plaques. In contrast, the hearts of the treated TO-2 hamsters exhibited normal gross morphology, similar to those of wild-type control F1B hamsters (data not shown). Histological staining further revealed large areas of cardiomyocyte degeneration, fibrosis or calcification in the untreated TO-2 hamsters (data not shown). However, those pathological signs were dramatically reduced or completely diminished in the AAVM41-treated hamster hearts. Echocardiography examination of the treated TO-2 hamsters also showed great improvement on all major parameters of cardiac functions, including left ventricle end-systolic dimension, percent fractional shortening, and left ventricle posterior wall thickness, nearly identical to those of wild-type F1B hamsters, but significantly different from those of the untreated TO-2 hamsters (P<0.05 by Student's t-test) (data not shown). These data further demonstrated the therapeutic efficacy by AAVM41 gene delivery in improving cardiac functions of TO-2 hamsters.

Example 7

Resistance of M41 to Pre-Existing Neutralizing Antibodies in Pooled Human IgGs

We investigated AAVM41 for its resistance to preexisting neutralizing antibodies. Commercially available human IVIG (pooled human IgGs for intravenous use) was used as the source of antibodies. AAVM41 was compared with AAV2, the best characterized serotype, and AAV8, a new isolate with low prevalence of pre-existing antibodies in human population. The AAV2-, AAV8-, and AAVM41-LacZ vectors were pre-incubated with serial dilutions of IVIG, inoculated on Huh7 cell culture for 4 days and then assayed for LacZ expression as an indicator of vector resistance to neutralization. At 1:64 dilution of IVIG, AAV2 infectivity decreased to 33%±4% of its control without IVIG. But AAV8 and AAVM41 infectivities remained at 94%±4% and 83%±1% of their controls. Even at the highest IVIG concentration (1:8 dilution), AAV8 and AAVM41 still retained 33%±12% and 26%±3% of their infectivities, while AAV2 was nearly completely neutralized under the same condition (data not shown).

Example 8

Sustained Transgene Expression from AAV Mutant Vectors

AAV vector is well-known for its sustained transgene expression in transduced tissues. To determine whether this characteristic is retained for the optimized AAV vectors, time course experiments are conducted, wherein $3 \times 10^{11}$ vector genomes of modified rAAV vector are injected into C57BL/6J mice by tail veil route, with rAAV9 vector as a control. At one week, two weeks, two months and five months after injection, a group of mice is sacrificed for each virus. Tissues including heart, liver, diaphragm and tibialis anterior are used for luciferase assay and gene copy number detection for evaluation of the persistence of transgene expression mediated by the optimized AAV vectors.

Example 9

In Vivo Screening for Resistance to Neutralizing Antibodies

For in vivo screening for resistance to neutralizing antibodies, a mixture of human IgGs (IVIG; a pool of IgG from thousands of donors) is injected into nude mice. The IVIG naturally contains a mixture of antibodies against all of the common AAVs seen by the human population. After IVIG into nude mice, the mutant AAV library is then injected into the mice and selection is carried out for viral genomes that entered the target tissue(s) of interest (heart, skeletal muscle, liver, etc). Those genomes that are isolated from the target tissue correspond to those capsids that are resistant to neutralization.

The foregoing is illustrative of the present invention, and is not to be construed as limiting thereof. The invention is defined by the following claims, with equivalents of the claims to be included therein.

SEQUENCE LISTING (140 sequences)

SEQ ID NO: 1 - DNA, 2211 bp, adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctaatacaatggctgcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgagtacgtgcctttccacagcagctacgcacacagccagagcctggaccggctgatgaatcctctcatcgaccaatacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctctcatgggcggctttggacttaagcacccgcctcctcagatcctcatcaaaaacacgcctgttcctgcgaatcctccggcagagttttcggctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 2 - protein, 736 aa, adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPNTMAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEYVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 3 - DNA, 2211 bp, adeno-associated virus
atggctgccgatggttatcttccagattggctcgaggacactctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggaacccgtcaacgcagcggacgcggcagccctcgagcacgacaaagcctacgaccagcagctcaaggccggtgacaacccgtacctcaagtacaaccacgccgacgccgagtttcaggagcgtctgcaagaagatacgtcatttgggggcaacctcgggcgagcagtcttccaggccaagaagcgggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcagcttcaagctcttcaacatccaagtcaaggaggtcacgacgaatgacggcgttacgaccatcgctaataaccttaccagcacgattcaggtattctcggactcggaataccagctgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttgagttcagctacagcttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgattttactgtggacaacaatggactttatactgagcctcgccccattggcacccgttaccttacccgtcccctgtaa

SEQ ID NO: 4 - protein, 736 aa, adeno-associated virus
MAADGYLPDWLEDTLSEGIREWWDLKPGAPKPKANQQKQDNGRGLVLPGYKYLGPFNGLDKGEPVNAADAAALEHDKAYDQQLKAGDNPYLKYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTIQVFSDSEYQLPYVLGSAHQGCLPPFPADVFMIPQYGYLTLNNGSQAVGRSSFYCLEYFPSQMLRTGNNFEFSYSFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5 - DNA, 2211 bp, adeno-associated virus
atggctgccgatggttatcttccagattggctcgaggacaacctctctgagggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaacctccagcagcgccctctggtgtgggacctaatacaatggcttcaggtggtggcgcaccaatggcagacaataacgagggtgccgatggagtgggtaattcctcaggaaattggcattgcgattccacatggctgggcgacagagtcatcaccaccagcacccgaacatgggccttgcccacctacaataaccacctctacaagcaaatctccagtgcttcaacgggggccagcaacgacaaccactactttggctacagcaccccctgggggtattttgatttcaacagattccactgccatttctcaccacgtgactggcagcgactcatcaacaacaactggggattccggcccaagagactcaacttcaaactcttcaacatccaagtcaaggaggtcacgacgaatgacggcgttacgaccatcgctaataaccttaccagcacggttcaagtcttctcggactcggagtaccagctgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccttctcagatgctgagaacgggcaacaactttgagttcagctacacttttgaggacgttcctttccacagcagctacgctcacagccagagtctggaccgtctcatgaatcctctcatcgaccagtacctgtattacttgagcagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 6 - protein, 736 aa, adeno-associated virus
MAADGYLPDWLEDNLSEGVREWWALQPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPSGVGPNTMASGGGAPMADNNEGADGVGNSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 7 - DNA, 2208 bp, adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgccagaaagagactcaatttcggtcagactggcgactcagagtcagtccccgaccctcaacctctcggagaacctccagcagcgccctctagtgtgggatctggtacagtggctgcaggtggtggcgcaccagtggcagacaataacgaaggcgccgacggagtgggtagttcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcccatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtaatctgtaa

SEQ ID NO: 8 - protein, 734 aa, adeno-associated virus
AADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDSESVPDPQPLGEPPAAPSSVGSGTVAAGGGAPVADNNEGADGVGSSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRNL

SEQ ID NO: 9 - DNA, 2211 bp, adeno-associated virus
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctggagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccgttgattgaatccccccagcagccagactcctccacgggcatcggcaagaaaggccagcagcccgccagaaagagactcaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggggacagagtcatcaccaccagcaccagaacctgggtcttgcccacctacaacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacctccaactttgaaaagcagactggtgtggactttgctgttaatacagaaggcgtgtactctgaaccccgccccattggcacccgttacctcacccgtaatctgtaa

SEQ ID NO: 10 - protein, 736 aa, adeno-associated virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLIESPQQPDSSTGIGKKGQQPARKRLNFGQTGDSESVPDPQPLGEPPAAPTSLGSNTMASGGGAPMADNNEGADGVGNSSGNWHCDSQWLGDRVITTSTRTWVLPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNFEKQTGVDFAVNTEGVYSEPRPIGTRYLTRNL

SEQ ID NO: 11 - DNA, 2211 bp, adeno-associated virus
atggctgccgatggttatcttccagattggctcgaggacaacctctctgaaggcgttcgagagtggtgggcgctgcaacctggagcccctaaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagaaaggccaacagcccgccagaaaaagactcaattttggtcagactggcgactcagagtcagttccagaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgcttcaacgggggccagcaacgacaaccactacttcggctacagcaccccctgggggtattttgatttcaacagattccactgccacttctcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaatcaaagccactaaccccgtggccaccgaaagatttgggaccgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 12 - protein, 736 aa, adeno-associated virus
MAADGYLPDWLEDNLSEGVREWWALQPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 13 - DNA, 2211 bp, adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcgggtagtaccaacgacaacacctacttcggctacagcaccccctgggggtattttgactttaacagattccactgccacttctcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagtcagtctgtgggacgttcctccttctactgcctggagtacttcccctctcagatgctgagaacgggcaacaactttgagttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccccgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 14 - protein, 736 aa, adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPSGVGPNTMAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 15 - DNA, 2211 bp, adeno-associated virus
atggctgccgatggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagcccgtcaacgcggcggacgcagcggccctggagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagttaaagaggtcacgcagaacgatggcacgacgactattgccaataaccttaccagcacggttcaagtgtttacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 16 - protein, 736 aa, adeno-associated virus
MAADGYLPDWLEDNLSEGIREWWALKPGVPQPKANQQHQDNRRGLVLPGYKYLGPGNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 17 - DNA, 2211 bp, adeno-associated virus
atggctgccgatggttatcttccagattggctcgaggacaacctctctgagggcattcgcgagtggtgggacttgaaacctggagcccctcaacccaaggcaaatcaacaacatcaagacaacgctcgaggtctggtgcttccgggttacaaataccttggacccggcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgaaaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 18 - protein, 736 aa, adeno-associated virus
MAADGYLPDWLEDNLSEGIREWWDLKPGAPQPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDEKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 19 - DNA, 2214 bp, adeno-associated virus
atggctgccgatggttatcttccagattggctcgaggacaacctctctgagggcattcgcgagtggtgggacctgaaacctggagccccgaaacccaaagcgaaccaacaacaccaggacaaccgtcggggtcttgtgcttccgggttacaaatacctcggacccggtaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagagggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtcctcggctctgcgcaccagggctgcctccctccgttcccggcggacgtgttcatgattccgcaatacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 20 - protein, 737 aa, adeno-associated virus
MAADGYLPDWLEDNLSEGIREWWDLKPGAPKPKANQQHQDNRRGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 21 - DNA, 2215 bp, adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctctcggtctggttgaggaaggcgctaagacggctcctgcaaagaaacgtccggtagagcagtcgccacaagagccagactcctcctcgggcatcggcaagaaaggccaacagcccgccagaaaaagactcaattttggtcagactggcgactcagagtcagttccagaccctcaacctctcggagaacctccagcagcgccctctagtgtgggatctggtacagtggctgcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaatcacctctacaagcaaatctccaacagcacatctggaggatcttcaaatgacaacgcctacttcggctacagcaccccctgggggtattttgatttcaacagattccactgccacttttcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgtcttcatggtgccacagtatggatacctcaccctgaacaacgggagtcaggcagtgggacgctcttcattttactgcctggagtactttccttcgcagatgctgagaaccggcaacaacttccagtttacttacaccttcgaggacgtgcctttccacagcagctacgcgcacagccagagcctggaccgtctcatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccctgtggccaccgaaagatttgggaccgtgacagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggaactgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaac

SEQ ID NO: 22 - protein, 737 aa, adeno-associated virus
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEQSPQEPDSSSGIGKKGQQPARKRLNFGQTGDSESVPDPQPLGEPPAAPSSVGSGTVAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMVPQYGYLTLNNGSQAVGRSSFYCLEYFPSQMLRTGNNFQFTYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVTVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 23 - DNA, 2208 bp, adeno-associated virus
atggctgccgatggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaagggggagcccgtcaacgcggcggacgcagcggccctggagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgaccctcaacctctcggagaacctccagcaacccccgctgctgtgggacctactacaatggctacaggcagtggcgcacccatggcagacaataacgagggtgccgaccgagtgggtaatgcctcacgaaattggcattgcgattccacatggctgggcgacagagtcatcaccaccaccacccgaacatgggccttgcccacctataacaaccacctctactatcaaatttccagccaatcaggagcctcgaacgacaatcactacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcccatttgggccaaaattcctcacacagatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccctgtaa

SEQ ID NO: 24 - protein, 735 aa, adeno-associated virus
MAADGYLPDWLEDNLSEGIREWWALKPGVPQPKANQQHQDNRRGLVLPGYKYLGPGNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMATGSGAPMADNNEGADRVGNASRNWHCDSTWLGDRVITTTTRTWALPTYNNHLYYQISSQSGASNDNHYFGYSTPWGYFDFNRFHCHFSPRDWQRLINNNWGFRPKRLSFKLFNIQVKEVTQNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 25 - DNA, 2208 bp, adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccttcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgccagaaagagactcaatttcggtcagactggcgactcagagtcagtccccgaccctcaacctctcggagaacctccagcagcgccctctagtgtgggatctggtacagtggctgcaggtggtggcgcaccagtggcagacaataacgaaggcgccgacggagtgggtagttcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcccatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtaatctgtaa

SEQ ID NO: 26 - protein, 735 aa, adeno-associated virus
MAADGYLPDWLEDNLSEGIREWWDLKPGAPKPKANQQKQDDGRGLVLPGYKYLGPFNGLDKGEPVNAADAAAFEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDSESVPDPQPLGEPPAAPSSVGSGTVAAGGGAPVADNNEGADGVGSSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRNL

SEQ ID NO: 27 - DNA, 2208 bp, adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtacctgcaaggacccatttgggccaaaattcctcacacggacggcaactttcacccttctccgctgatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccctattggcactcgttacctcacccgtaatctgtaa

SEQ ID NO: 28 - protein, 735 aa, adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGNFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRNL

SEQ ID NO: 29 - DNA, 2211 bp, adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagttccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgattttactgtggacaacaatggactttatactgagcctcgccccattggcacccgttaccttacccgtcccctgtaa

SEQ ID NO: 30 - protein, 736 aa, adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 31 - DNA, 2211 bp, adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccagcagctcaaggccggtgacaacccgtacctcaagtacaaccacgccgacgccgagtttcaggagcgtcttcaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgactcagagtcagttccagaccctcaacctctcggagaacctccagcagcgccctctggtgtgggacctaatacaatggctgcaggcggtggcgcaccagtggcagacaataacgaaggcgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgatttcaacagattccactgccatttctcaccacgtgactggcagcgactcattaacaacaactggggattccggcctaagcgactcaacttcaagctcttcaacattcaggtcaaagaggttacggacaacaatggagtcaagaccatcgccaataaccttaccagcacggttcaagtcttctcggactcggagtaccagcttccgtacgtcctcggctctgcgcaccagggctgcctccctccgttcccggcggacgtgttcatgattccgcaatacggctacctgactctcaacaatggcagccaagccgtgggacgctcctccttctactgcctggaatactttccttcgcagatgctgagaacgggcaacaactttaccttcagctacacctttgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 32 - protein, 736 aa, adeno-associated virus
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPAAPSGVGPNTMAAGGGAPVADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTDNNGVKTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 33 - DNA, 2211 bp, adeno-associated virus
atggctgccgatggttatcttccagattggctcgaggacaacctctctgagggcattcgcgagtggtgggacttgaaacctggagcccctcaacccaaggcaaatcaacaacatcaagacaacgctcgaggtctggtgcttccgggttacaaataccttggacccggcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 34 - protein, 736 aa, adeno-associated virus
MAADGYLPDWLEDNLSEGIREWWDLKPGAPQPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 35 - DNA, 2211 bp, adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggaacccgtcaacgcggcggacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtcccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctacaacaatcacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 36 - protein, 736 aa, adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 37 - DNA, 2211 bp, adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagtagtcttccaggccaagaagagggttcttgaacctcttggtctggttgagcaagcgggtgagacggctcctggaaagaaacgtccggtagagcagtcgccacaagagccagactcctcctcgggcattggcaagacaggccagcagcccgctaaaaagagactcaattttggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagttggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgttatgggagccttacctggtatggtttggcaggacagagatgtgtacctgcaaggacccatttgggccaaaattcctcacacggacggcaactttcacccttctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 38 - protein, 736 aa, adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLKYNHADAEFQQRLQGDTSFGGNLGRVVFQAKKRVLEPLGLVEQAGETAPGKKRPVEQSPQEPDSSSGIGKTGQQPAKKRLNFGQTGDSESVPDPQPLGEPPAAPSSVGSGTVAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPVGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGNFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 39 - DNA, 2208 bp, adeno-associated virus
gctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggaacccgtcaacgcggcggacgcggcggccctcgagcacgacaaggcctacgaccagcagctcaaggccggtgacaacccgtacctcaagtacaaccacgccgacgccgagtttcaggagcgtctgcaagaagatacgtcttttgggggcaacctcgggcgagcagtcttccaggccaagaagagggttctcgaacctctcggtctggttgaggaaggtgctaagacggctcctggaaagaaacgtccggtagagcagtcgccacaagagccagactcctcctcgggcatcggcaagacaggccagcagcccgctaaaaagagactcaatttcggtcagactggcgactcagagtcagtcccagaccctcaacctctcggagaacctccagcagcgccctctagtgtgggatctggtacagtggcttcaggcggtggcgcaccaatggcagacaataacgaaggcgccgacggagtgggtaatgcctcaggaaattggcattgcgattccacatggctgggcgacagagtcattaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaagccgtgggacggtcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggagattgaatgggaactgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccctgtaa

SEQ ID NO: 40 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLKYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSSVGSGTVASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 41 - DNA, 2211 bp, adeno-associated virus
gctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtcccagaccctcaacctctcggagaacctccagcaacccccgctgctgtgggacctactacaatggctacaggcagtggcgcaccaatggcagacaataacgagggtgccgacggagtgggtaatgcctcaggaaattggcattgcgattccacatggctgggcgacagagtcatcaccaccagcacccgaacatgggccctgcccacctacaacaaccacctctacaagcaaatctccaacagcacatctggaggatcttcaaatgacaacgcctacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgacggcgttacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaatcaaagccactaaccccgtggccaccgaaagatttgggaccgtggcagtcaatctccagagcagcagcacagaccctgcgaccggagatgtgcatgttatgggagccttacctggaatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 42 - protein, 734 aa, adeno-associated virus
DGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMATGSGAPMADNNEGADGVGNASGNWHCDSTWLGDRVITTSTRTWALPTYNNHLYKQISNSTSGGSSNDNAYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 43 - DNA, 2205 bp, adeno-associated virus
gctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggaacccgtcaacgcagcggacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgaccctcaacctctcggagaacctccagcagcgccctctagtgtgggatctggtacaatggctgcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaaacaaatttccagccaatcaggagcctcgaacgacaatcactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgcagaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatactttccttcgcagatgctgagaacgggcaataactttaccttcagctacaccttcgaggacgtgcctttccacagcagctacgcgcacagccagagcctggaccgtctcatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagccttacctggcatggtgtggcaagatagagacgtgtacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 44 - protein, 732 aa, adeno-associated virus
DGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSSVGSGTMAAGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 45 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggaacccgtcaacgcagcggacgcggcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggctacaggcagtggcgcaccaatggcagacaataacgagggtgccgacggagtgggtaatgcctcaggaaattggcattgcgattccacatggctgggcgacagagtcatcaccaccagcaccagaacctgggccctgcccacttacaacaatcacctctacaagcaaatctccagtgaaactgcaggtagtaccaacgacaatcactactttggctacagcaccccttgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagttggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccctgtaa

SEQ ID NO: 46 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMATGSGAPMADNNEGADGVGNASGNWHCDSTWLGDRVITTSTRTWALPTYNNHLYKQISSETAGSTNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPVGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 47 - DNA, 2208 bp, adeno-associated virus
gctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcattggcaagaaaggccaacagcccgccagaaaaagactcaattttggtcagactggcgactcagagtcagttccagaccctcaacctctcggagaacctccagcagcgccctctagtgtgggatctggtacagtggctgcaggcggtggcgcaccaatggcagacaataacgagggcgccgacggagtgggtaatgcctcaggaaattggcattgcgattccacatggctgggcgacagagtcatcaccaccagcacccgaacatgggccttgcccacctacaacaatcacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccctgtaa

SEQ ID NO: 48 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 49 - DNA, 2208 bp, adeno-associated virus
gctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagcgccctctagtgtgggacctactacaatggcttcaggcggtggcgcaccaatggcagacaataacgaaggtgccgacggagtgggtaatgcctcaggaaattggcattgcgattccacatggctgggcgacagagtcatcaccaccagcacccgcacctgggccttgcccacctataacaaccacctctacaagcaaatctccagtgaaactgcaggtagtaccaacgacaacacctacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctgacgctcaacaatggcagccaagccgtgggacgttcatccttttactgcctggaatactttccttcgcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatctccagagcagcagcacagaccctgcgaccggagatgtgcatgttatgggagccttacctggaatggtgtggcaagacagagacgtgtacctgcaaggacccatttgggccaaaattcctcacacggacggcaactttcacccttctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 50 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPSSVGPTTMASGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGNFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 51 - DNA, 2208 bp, adeno-associated virus
gctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggaacccgtcaacgcagcggacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcatcggcaagacaggccagcagcccgccagaaaaagactcaattttggtcagactggcgactcagagtcagtcccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcctaagcgactcaacttcaagctcttcaacattcaggtcaaagaggttacggacaacaatggagtcaagaccatcgccaataaccttaccagcacggttcaagtcttctcggactcggagtaccagcttccgtacgtcctcggctctgcgcaccagggctgcctccctccgttcccggcggacgtgttcatgattccgcagtacggctacctgacgctcaacaatggcagccaagccgtgggacgctcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagccttacctggcatggtgtggcaagacagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccatgtaa

SEQ ID NO: 52 - protein, 733 aa, adeno-associated virus
DGYLPDWLEDTLSEGIRQWWKLKPGPPPPKPAERHKDDSRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPTSLGSNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPM

SEQ ID NO: 53 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggaacccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcatcggcaagaaaggccaacagcccgccagaaaaagactcaattttggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgatttcaacagattccactgccatttctcaccacgtgactggcagcgactcatcaacaacaattggggattccggcctaagcgactcaacttcaagctcttcaacattcaggtcaaagaggttacggacaacaatggagtcaagaccatcgccaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagttggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggactgtggcagtcaatttccagagcagcagcacagaccctgcgaccggagatgtgcatgttatgggagcattacctggcatggtgtggcaagatatagacgtgtacctgcagggtcccatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtatacatctaactatgcaaaatctgccaacgttgattttactgtggacaacaatggactttatactgagcctcgccccattggcacccgttacctcacccgtcccctgtaa

SEQ ID NO: 54 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTDNNGVKTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPVGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDIDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 55 - DNA, 2208 bp, adeno-associated virus
gctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagagggttctcgaacctctcggtctggttgaggaaggcgctaagacggctcctggaaagaaacgtccggtagagcagtcgccacaagagccagactcctcctcgggcatcggcaagacaggccagcagcccgccagaaaaagactaaatttcggtcagactggcgactcagagtcagttccagaccctcaacctctcggagaacctccagcaacccccgctgctgtgggacctaatacaatggcttcaggtggtggcgcaccaatggcagacaataacgaaggcgccgacggagtgggtaatgcctcaggaaattggcattgcgattccacatggatgggcgacagagtcatcaccaccagcacccgcacctgggccttgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaattggggattccggcccaagagactcaacttcaaactcttcaacatccaagtcaaggaggtcacgacgaatgacggcgttacgaccatcgctaataaccttaccagcacggttcaagtcttctcggactcggagtaccagctgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaatcaaagccactaaccccgtggccaccgaaagatttgggaccgtggcagtcaatctccagagcagcagcacagaccctgcgaccggagatgtgcatgttatgggagccttacctggaatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 56 - protein, 733 aa, adeno-associated virus
DGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPATPAAVGPNTMASGGGAPMADNNEGADGVGNASGNWHCDSTWMGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 57 - DNA, 2208 bp, adeno-associated virus
gctgccgatggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcagacgccgcggccctcgagcacgacaaagcctacgaccagcagctcaaggccggtgacaacccgtacctcaagtacaaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgaccctcaacctctcggagaacctccagcagcgccctctagtgtgggatctggtacagtggctgcaggcggtggcgcaccaatggcagacaataacgagggtgccgacggagtgggtaatgcctcaggaaattggcattgcgattccacatggctgggcgacagagtcatcaccaccagcacccgaacatgggccttgcccacctacaacaatcacctctacaagcaaatctccagtgcttcaacgggggccagcaacgacaaccactacttcggctacagcaccccctgggggtattttgactttaacagattccactgccacttttcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggcatggtgtggcaagatagagacgtgtacctgcagggtcccatttgggccaaaattcctcacacagatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatccaattatgcaaaatctgccaacgttgattttactgtggacaacaatggactttatactgagcctcgccccattggcacccgttacctcacccgtcccctgtaa

SEQ ID NO: 58 - protein, 733 aa, adeno-associated virus
DGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSSVGSGTVAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 59 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagttccagaccctcaacctctcggagaacctccagcagcgccctctggtgtgggacctaatacaatggctgcaggcggtggcgcaccagtggcagacaataacgaaggcgccgacggagtgggtaatgcctcaggaaattggcattgcgattccacatggatgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctaacgctcaacaatggcagccaggcagtgggacggtcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagttggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagccttacctggcatggtgtggcaagacagagacgtgtacctgcagggtcccatttgggccaaaattcctcacacggatggacactttcacccgtctcctctcatgggcggctttggacttaagcacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaaacgctggaatcccgaagtgcagtatacatctaactatgcaaaatctgccaacgttgattttactgtggacaacaatggactttatactgagcctcgccccattggcacccgttaccttacccgtcccctgtaa

SEQ ID NO: 60 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGPNTMAAGGGAPVADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPVGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 61 - DNA, 2208 bp, adeno-associated virus
gctgccgatggttatcttccagattggctcgaggacaacctttctgaaggcattcgtgagtggtgggctctgaaacctggagtccctcaacccaaagcgaaccaacaacaccaggacaaccgtcggggtctggtgcttccgggttacaaataccttggacccggcaacggactcgacaagggagagccggtcaacgaggcagacgccgcggccctcgagcacgacaaggcctacgaccagcagctcaaggccggtgacaacccctacctcaagtacaaccacgccgacgcggagttccagcagcggcttcaagaagatacgtcttttgggggcaacctcgggcgagcagtcttccaggccaagaagcgggttcttgaacctcttggtctggttgagcaagcgggtgagacggctcctggaaagaaacgtccggtagagcagtcgccacaagagccagactcctcctcgggcattggcaagacaggccagcagcccgctaaaaagagactcaatttcggtcagactggcgactcagagtcagtccccgatccacaacctctcggagaacctccagcaacccccgctgctgtgggacctactacaatggctacaggcagtggcgcaccaatggcagacaataacgaaggcgccgacggagtgggtaatgcctcaggaaattggcattgcgattccacatggctgggcgacagagtcatcaccaccagcacccgcacctgggccttgcccacctacaacaaccacctctacaagcaaatctccagtgaaactgcaggtagtaccaacgacaacacctacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgccaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaatcaaagccactaaccccgtggccaccgaaagatttgggaccgtggcagtcaatttccagagcagcagcacagaccctgcgaccggagatgtgcatgctatgggagcattacctggcatggtgtggcaagatagagacgtgtacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccctgtaa

SEQ ID NO: 62 - protein, 733 aa, adeno-associated virus
DGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQQRLQEDTSFGGNLGRAVFQAKKRVLEPLGLVEQAGETAPGKKRPVEQSPQEPDSSSGIGKTGQQPAKKRLNFGQTGDSESVPDPQPLGEPPATPAAVGPTTMATGSGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 63 - DNA, 2208 bp, adeno-associated virus
gctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggagagccggtcaacgaggcagacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctctcggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagcgccctctagtgtgggatctggtacagtggctgcaggcggtggcgcaccaatggcagacaataacgagggtgccgacggagtgggtaatgcctcaggaaattggcattgcgattccacatggctgggcgacagagtcatcaccaccagcacccgaacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcattaacaacaactggggattccggcctaagaagctgcggttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccctgtggccaccgaaagatttgggaccgtggcagtcaatttccagagcagcagcacagaccctgcgaccggagatgtgcatgctatgggagcattacctggaatggtgtggcaagacagagacgtatacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 64 - protein, 733 aa, adeno-associated virus
DGYLPDWLEDNLSEGIREWWDLKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSSVGSGTVAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 65 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctggagcacgacaaggcctacgaccagcagctcaaagcgggagacaacccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagaaaggccaacagcccgccagaaaaagactcaattttggtcagactggcgactcagagtcagttccagaccctcaacctctcggagaacctccagcagcgccctctggtgtgggacctaatacaatggcttcaggtggtggcgcaccaatggcagacaataacgaaggcgccgacggagtgggtaatgcctcaggaaattggcattgcgattccacatggctgggcgacagagtcatcaccaccagcaccagaacctgggccctgcccacctacaacaaccacctctacaaacaaatttccagtgcttcaacgggggccagcaacgacaaccactacttcggctacagcaccccctgggggtattttgatttcaacagattccactgccacttctcaccacgtgactggcagcgactcatcaacaacaactggggattccggcccaagagactcaacttcaaactcttcaacatccaagtcaaggaggtcacgacgaatgacggcgttacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccaatacctgtattacctgaacagaactcagaatcagtccggaagtgcccaaaacaaggacttgctgtttagccgagggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgaaaaagacaagttctttcccatgagcggtgtcatgatttttggaaaagagagcgccggagcttcaaacactgcattggacaatgtcatgattacagacgaagaggaaatcaaagccactaaccccgtggccaccgaaagatttgggaccgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 66 - protein, 733 aa, adeno-associated virus
DGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDEKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 67 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaatcaggacaacggccggggtctggtgcttcctggctacaaataccttggacccggcaacggactcgacaagggggagcccgtcaacgcggcggacgcagcggccctggagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggctgcaggtggtggcgcaccaatggcagacaataacgaaggcgccgacggagtgggtagttcctcgggaaattggcattgcgattccacatggatgggcgacagagtcatcaccaccagcacccgaacctgggccctgcccacctacaacaaccacctctacaagcaaatctccagtgaaactgcaggtagtaccaacgacaacacctacttcggctacagcaccccctgggggtattttgatttcaacagattccactgccatttctcaccacgtgactggcagcgactcatcaacaacaactggggattccggcccaagaaactgcggttcaagctcttcaacatccaagtcaaggaggtcacgacgaatgatggcgtcacaaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacaccttcgagtacgtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggaccgtggcagtcaatttccagagcagcagcacagaccctgcgaccggagatgtgcatgctatgggagcattacctggcatggtgtggcaagatagagacgtgtacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 68 - protein, 733 aa, adeno-associated virus
DGYLPDWLEDNLSEGIREWWDLKPGAPKPKANQQNQDNGRGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMAAGGGAPMADNNEGADGVGSSSGNWHCDSTWMGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEYVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 69 - DNA, 2208 bp, adeno-associated virus
gctgccgatggttatcttccagattggctcgaggacaacctctctgagggcattcgcgagtggtgggacctgaaacctggagccccgaaacccaaggcaaatcaacaacatcaggacaacgctcggggtcttgtgcttccgggttacaaatacctcggacccttcaacggactcgacaagggggagccggtcaacgcagcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggtgctaagacggctcctggaaagaaacgtccggtagagcagtcgccacaagagccagactcctcctcgggcatcggcaagaaaggccaacagcccgccagaaaaagactcaattttggtcagactggcgactcagagtcagtccccgatccacaacctctcggagaacctccagcaacccccgctgctgtgggacctactacaatggcttcaggcggtggcgcaccaatggcagacaataacgaaggtgccgacggagtgggtagttcctcgggaaattggcattgcgattccacatggctgggcgacagagtcatcaccaccagcacccgcacctgggccttgcccacctacaataaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctgcctccgttcccggcggacgtgttcatgattccgcaatacggctacctgacgctcaacaatggcagtcagtctgtgggacgttcctccttctactgcctggagtacttcccctctcagatgctgagaacgggcaacaactttgagttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatctaactatgcaaaatctgccaacgttgattttactgtggacaacaatggactttatactgagcctcgccccattggcacccgttaccttacccgtcccctgtaa

SEQ ID NO: 70 - protein, 733 aa, adeno-associated virus
DGYLPDWLEDNLSEGIREWWDLKPGAPKPKANQQHQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKKGQQPARKRLNFGQTGDSESVPDPQPLGEPPATPAAVGPTTMASGGGAPMADNNEGADGVGSSSGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 71 - DNA, 2208 bp, adeno-associated virus
gctgccgatggttatcttccagattggctcgaggacaacctctctgagggcattcgcgagtggtgggacctgaaacctggagccccgaaacccaaagccaaccagcaaaagcaggacaaccgtcggggtctggtgcttccgggttacaaatacctcggacccggtaacggactcgacaaaggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgccagaaagagactcaatttcggtcagactggcgactcagagtcagtccccgaccctcaacctctcggagaacctccagcagcgccctctggtgtgggacctaatacaatggctgcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctacaataaccacctctacaagcaaatctccagtgaaactgcaggtagtaccaacgacaacacctacttcggctacagcaccccctgggggtattttgactttaacagattccactgccacttttcaccacgtgactggcagcgactcatcaacaacaactggggattccggcccaagaagctgcggttcaagctcttcaacatccaagtcaaggaggtcacgacgaatgacggcgttacgaccatcgctaataaccttaccagcacggttcaagtcttctcggactcggagtaccagttgccgtacgtcctcggctctgcgcaccagggctgcctccctccgttcccggcggacgtcttcatgattcctcagtacggctacctgactctcaacaatggcagtcagtctgtgggacgttcctccttctactgcctggaatatttcccctctcagatgctgagaacgggcaacaactttgagttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatccatcatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatctaactatgcaaaatctgccaacgttgattttactgtggacaacaatggactttatactgagcctcgccccattggcacccgttacctcacccgtcccctgtaa

SEQ ID NO: 72 - protein, 733 aa, adeno-associated virus
DGYLPDWLEDNLSEGIREWWDLKPGAPKPKANQQKQDNRRGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPSGVGPNTMAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 73 - DNA, 2208 bp, adeno-associated virus
gctgccgatggttatcttccagattggctcgaggacaacctctctgagggcattcgcgagtggtgggcgctgcaacctggagcccctcaacccaaggcaaatcaacaacatcaagacaacgctcgaggtcttgtgcttccgggttacaaataccttggacccggcaacggactcgacaagggggagcccgtcaacgcggcggacgcggcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccaacagcccgccagaaaaagactcaattttggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattccacatggctgggcgacagagtcatcaccaccagcaccagaacctgggtcttgcccacctacaacaaccacctctacaagcaaatctccagtgaaactgcaggtagtaccaacgacaacacctacttcggctacagcaccccctgggggtattttgactttaacagattccactgccacttttcaccacgtgactggcagcgactcatcaacaacaactggggattccggcccaagaagctgcggttcaagctcttcaacatccaagtcaaggaggtcacgacgaatgacggcgttacgaccatcgctaataaccttaccagcacggttcaagtcttctcggactcggagtaccagctgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttgagttcagctacacttttgaggacgttcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggactgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 74 - protein, 733 aa, adeno-associated virus
DGYLPDWLEDNLSEGIREWWALQPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPTSLGSNTMASGGGAPMADNNEGADGVGNSSGNWHCDSTWLGDRVITTSTRTWVLPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 75 - DNA, 2208 bp, adeno-associated virus
gctgccgatggttatcttccagattggctcgaggacaacctctctgagggcattcgcgagtggtgggacttgaaacctggagccccgaagcccaaagccaaccagcaaaagcaggacaacgctcggggtcttgtgcttccgggttacaagtacctcggacccttcaacggactcgacaaaggagagcccgtcaacgcggcggatgcagcggccctggagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctctcggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgttacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaattttacctggactggtgcttcaaaatataaccttaatgggcgtgaatccatcatcaaccctggcactgctatggcctcacacaaagacgaaaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagaacagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 76 - protein, 733 aa, adeno-associated virus
DGYLPDWLEDNLSEGIREWWDLKPGAPKPKANQQKQDNARGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDEKDKFFPMSGVMIFGKESAGASNTALDNVMITDEEEIKATNPVATERFGTVAVNFQNSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 77 - DNA, 2208 bp, adeno-associated virus
gctgccgatggttatcttccagattggctcgaggacaacctctctgagggcattcgcgagtggtgggacttgaaacctggagccccgaaacccaaggcaaatcaacaacatcaggacaacgctcggggtcttgtgcttccgggttacaaatacctcggacccggcaacggactcgacaagggggagcccgtcaacgcggcggatgcagcggccctcgagcacgacaaggcctacgaccagcagctcaaggccggagacaacccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaatgcctcaggaaattggcattgcgattccacatggctgggcgacagagtcatcaccaccagcacccgaacatgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagaagctgcggttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaataactttaccttcagctacacctttgaggacgtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaacactgcattggacaatgtcatgatcacagacgaagaggaaattaaagccactaaccccgtggccaccgaaagatttgggactgtggcagtcaatttccagagcagcagcacagaccctgcgaccggagatgtgcatgttatgggagcattacctggcatggtgtggcaagatagagacgtatacctgcagggtcccatttgggccaaaattcctcacacagatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 78 - protein, 733 aa, adeno-associated virus
DGYLPDWLEDNLSEGIREWWDLKPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 79 - DNA, 2208 bp, adeno-associated virus
gctgccgatggttatcttccagattggctcgaggacaacctctctgaaggcattcgcgagtggtgggctctgaaacctggagtccctcaacccaaagcgaatcaacaacatcaggacaacgctcggggtcttgtgcttccgggttacaaatacctcggacccttcaacggactcgacaagggggagcccgtcaacgcggcggacgcagcggccctggagcacgacaaggcctacgaccagcagctcaaggccggagacaacccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagaaaggccagcagcccgctaaaaagagactcaattttggtcagactggcgactcagagtcagtcccagaccctcaacctctcggagaacctccagcaacccccgctgctgtgggatctactacaatggctgcaggcggtggcgcaccaatggcagacaataacgagggtgccgacggagtgggtaatgcctcaggaaattggcattgcgattccacatggatgggcgacagagtcatcaccaccagcacccgcacctgggccctgcccacctacaacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacgctcctccttctactgcctggaatactttccttcgcagatgctgagaacgggcaacaactttaccttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcccatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccaatactccacaggacaagtgagtgtggaaattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccctgtaa

SEQ ID NO: 80 - protein, 733 aa, adeno-associated virus
DGYLPDWLEDNLSEGIREWWALKPGVPQPKANQQHQDNARGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPATPAAVGSTTMAAGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 81 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggaacccgtcaacgcagcggacgcggcggccctcgagcacgacaaggcctacgaccagcagctcaaagcgggtgacaatccgtacctgcggtataaccacgccgacgccgagtttcaggagcgtctgcaagaagatacgtcttttgggggcaaccttggcagagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgaccctcaacctctcggagaacctccagcagcgccctctggtgtgggacctaatacaatggctgcaggcggtggcgcaccaatggcagacaataacgaaggtgccgacggagtgggtaattcctcgggaaattggcattgcgattccacatggatgggcgacagagtcattaccaccagcacccgaacctgggccctgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaggtcaaggaggtcacgcagaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcccatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 82 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 83 - DNA, 2208 bp, adeno-associated virus
gctgccgatggttatcttccagattggctcgaggacaacctttctgagggcattcgcgagtggtgggacttgaaacctggagcccctcaacccaaagcgaaccaacaacaccaggacaaccgtcggggtcttgtgcttccgggttacaaatacctcggacccggcaacggactcgacaaaggagagcccgtcaacgcagcagacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagagggttctcgaacctctcggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcattaccaccagcacccgaacatgggccttgcccacctataacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaattggggattccggcctaagcgactcaacttcaagctcttcaacatccaggtcaaggaggtcacgacgaatgatggcgtcacaaccatcgctaataaccttaccagcacggttcaagtcttctcggactcggagtaccagctgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 84 - protein, 733 aa, adeno-associated virus
DGYLPDWLEDNLSEGIREWWDLKPGAPQPKANQQHQDNRRGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 85 - DNA, 2208 bp, adeno-associated virus
gctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcagcggacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagaggatccttgagcctcttggtctggttgaggaagcagctaaaacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttctcaccacgtgactggcagcgactcatcaacaacaattggggattccggcccaagaagctgcggttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaacaactttgagttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccccgtggccaccgaaagatttgggactgtggcagtcaatttccagagcagcagcacagaccctgcgaccggagatgtgcatgctatgggagcattacctggcatggtgtggcaagacagagacgtgtacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 86 - protein, 733 aa, adeno-associated virus
DGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRILEPLGLVEEAAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 87 - DNA, 2208 bp, adeno-associated virus
gctgccgatggttatcttccagattggctcgaggacaacctctctgagggcattcgcgagtggtgggcgctgaaacctggagccccgaaacccaaagccaaccagcaaaagcaggacgacggccggggtctggtgcttcctggctacaagtacctcggacccttcaacggactcgacaagggggaacccgtcaacgcagcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgccagaaagagactcaatttcggtcagactggcgactcagagtcagtccccgaccctcaacctctcggagaacctccagcaacccccgctgctgtgggacctaatacaatggctgcaggcggtggcgcaccaatggcagacaataacgaaggtgccgacggagtgggtaatgcctcaggaaattggcattgcgattccacatggctgggcgacagagtcatcaccaccagcacccgaacctgggccttgcccacctacaataaccacctctacaagcaaatctccagtgcttcaacgggggccagcaacgacaaccactactttggctacagcaccccctgggggtattttgactttaacagattccactgccacttctcaccacgtgactggcagcgactcatcaacaacaattggggattccggcccaagaagctgcggttcaagctcttcaacatccaggtcaaggaggtcacgacgaatgacggcgttacgaccatcgctaataaccttaccagcacgattcaagtcttctcggactcggagtaccagttgccgtacgtcctcggctctgcgcaccagggctgcctccctccgttcccggcggacgtgttcatgattccgcaatacggctacctaacgctcaacaatggcagccaggcagtgggacgttcctccttctactgcctggagtacttcccctctcagatgctgagaacgggcaacaactttgagttcagctacaccttcgaggacgttcctttccacagcagctacgcgcacagccagagcctggaccggctgatgaatcctctcatcgaccaatacctgtattacctgaacagaactcagaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccccgtggccaccgaaagatttgggactgtggcagtcaatctccagagcagcagcacagaccctgcgaccggagatgtgcatgctatgggagcattacctggcatggtgtggcaagatagagacgtgtacctgcagggtcctatttgggccaaaattcctcacacagatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 88 - protein, 733 aa, adeno-associated virus
DGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDSESVPDPQPLGEPPATPAAVGPNTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 89 - DNA, 2208 bp, adeno-associated virus
gctgccgatggttatcttccagattggctcgaggacaacctctctgagggcattcgcgagtggtgggacttgaaacctggagcccctcaacccaaggcaaatcaacaacatcaagacaacgctcgaggtctggtgcttccgggttacaaataccttggacccggcaacggactcgacaagggggagcccgtcaacgcggcggacgcagcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccaacagcccgccagaaaaagactcaatttcggtcagactggcgactcagagtcagtccccgaccctcaacctctcggagaacctccagcaacccccgctgctgtgggacctaatacaatggcttcaggcggtggcgcaccaatggcagacaataacgaaggcgccgacggagtgggtaatgcctcaggaaattggcattgcgattccacatggatgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttaccttcagctacacctttgaggaagtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccccgtggccaccgaaagatttgggaccgtggcagtcaatttccagagcagcagcacagaccctgcgaccggagatgtgcatgctatgggagccttacctggaatggtgtggcaagacagagacgtgtacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 90 - protein, 733 aa, adeno-associated virus
DGYLPDWLEDNLSEGIREWWDLKPGAPQPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPATPAAVGPNTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 91 - DNA, 2208 bp, adeno-associated virus
gctgccgatggttatcttccagattggctcgaggacaacctctctgagggcattcgcgagtggtgggcgctgcaacctggagcccctaaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctgcggtataaccacgccgacgccgagtttcaggagcgtctgcaagaagatacgtcttttgggggcaacctcgggcgagcagtcttccaggccaaaaagagggttctcgaaccttttggtctggttgaggaaggcgctaagacggctcctggaaagaaacgtccggtagagcagtcgccacaagagccagactcctcctcgggcatcggcaagaaaggccaacagcccgccagaaaaagactcaattttggtcagactggcgactcagagtcagttccagaccctcaacctctcggagaacctccagcagcgccctctggtgtgggacctaatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctacaataaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagttgccgtacgtcctcggctctgcgcaccagggctgcctgcctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccaatacctgtattacctgagcagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccccgtggccaccgaaagatttgggaccgtggcagtcaatttccagagcagcagcacagaccctgcgaccggagatgtgcatgttatgggagccttacctggaatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccaatactccacaggacaagtgagtgtggaaattgaatgggagctgcagaaagaaaacagcaaacgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 92 - protein, 733 aa, adeno-associated virus
DGYLPDWLEDNLSEGIREWWALQPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKKGQQPARKRLNFGQTGDSESVPDPQPLGEPPAAPSGVGPNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 93 - DNA, 2208 bp, adeno-associated virus
gctgccgatggttatcttccagattggctcgaggacaacctctctgagggcattcgcgagtggtgggacttgaaacctggagcccctcaacccaaggcaaatcaacaacatcaagacaacgctcggggtcttgtgcttccgggttacaaatacctcggacccggtaacggactcgacaagggggaacccgtcaacgcagcggacgcggcagccctcgagcacgacaaggcctacgaccaacagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcatcaccaccagcacccgaacctgggccttgcccacctataacaaccacctctacaagcaaatctccagtgcttcaacgggggccagcaacgacaaccactactttggctacagcaccccctgggggtattttgatttcaacagattccactgccatttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaggcagtgggacgttcatccttttactgcctggaatatttcccatcgcagatgctgagaacgggcaataactttaccttcagctacaccttcgaggacgtgcctttccacagcagctacgcgcacagccagagtctggaccgtctcatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 94 - protein, 733 aa, adeno-associated virus
DGYLPDWLEDNLSEGIREWWDLKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 95 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaagcaggacaacggccggggtctggtgcttcctggctacaagtacctcggacccggcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctctcggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtcccagaccctcaacctctcggagaacctccagcagcgccctctggtgtgggacctaatacaatggcttcaggtggtggcgcaccaatggcagacaataacgaaggtgccgacggagtgggtaattcctcaggaaattggcattgcgattccacatggctgggcgacagagtcatcaccaccagcacccgaacatgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagctgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccttctcagatgctgagaacgggcaacaactttgagttcagctacacttttgaggacgttcctttccacagcagctacgctcacagccagagtctggaccgtctcatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatctccagagcagcagcacagaccctgcgaccggagatgtgcatgctatgggagcattacctggcatggtgtggcaagatagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccaatactccacaggacaagtgagcgtggaaattgaatgggagctgcagaaagaaaacagcaaacgctggaatcccgaagtgcagtatacatctaactatgcaaaatctgccaacgttgattttactgtggacaacaatggactttatactgagcctcgccccattggcacccgttaccttacccgtcccctgtaa

SEQ ID NO: 96 - protein, 733 aa, adeno-associated virus
DGYLPDWLEDNLSEGIREWWDLKPGAPKPKANQQKQDNGRGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGPNTMASGGGAPMADNNEGADGVGNSSGNWHCDSTWLGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 97 - DNA, 2208 bp, adeno-associated virus
gctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaaaaagaggatccttgagcctcttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctaatacaatggctgcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacgattcaggtattctcggactcggaataccagcttccgtacgtcctcggctctgcgcaccagggctgcctgcctccgttcccggcggacgtgttcatgattccgcagtacggctacctgacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccccgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 98 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRILEPLGLVEEGAKTAPGKKRPVEQSPQEPDSSSGIGKTGQQPAKKRLNFGQTGDSESVPDPQPLGEPPATPAAVGPNTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 99 - DNA, 2208 bp, adeno-associated virus
gctgccgatggttatcttccagattggctcgaggacaacctctctgagggcattcgcgagtggtgggacttgaaacctggagcccctcaacccaaggcaaatcaacaacatcaagacaacgctcgaggtctggtgcttccgggttacaaataccttggacccggcaacggactcgacaagggggaacccgtcaacgcagcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagagggttctcgaacctctcggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtcccagaccctcaacctctcggagaacctccagcagcgccctctggtgtgggacctaatacaatggctgcaggcggtggcgcaccaatggcagacaataacgaaggcgccgacggagtgggtaatgcctcaggaaattggcattgcgattccacatggctgggcgacagagtcattaccaccagcaccagaacctgggtcttgcccacctacaacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagttggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctccaaccattggcacccgttacctcacccgtcccctgtaa

SEQ ID NO: 100 - protein, 733 aa, adeno-associated virus
DGYLPDWLEDNLSEGIREWWDLKPGAPQPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGNASGNWHCDSTWLGDRVITTSTRTWVLPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPVGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPPTIGTRYLTRPL

SEQ ID NO: 101 - DNA, 2208 bp, adeno-associated virus
gctgccgatggttatcttccagattggctcgaggacaacctctctgagggcattcgcgagtggtgggcgctgaaacctggagccccgaaacccaaagcgaaccaacaacaccaggacaaccgtcggggtcttgtgcttccgggttacaaatacctcggacccggcaacggactcgacaagggggaacccgtcaacgcagcggacgcggcagccctcgagtacgacaaggcctacgaccagcagctcaaagcgggtgacaacccgtacctgcggtataaccacgccgacgccgagtttcaggagcgtctgcaagaagatacgtcttttgggggcaacctcgggcgagcagtcttccaggccaaaaagagggttctcgaacctctcggtctggttgaggaaggcgctaagacggctcctggaaagaaacgtccggtagagcagtcgccacaagagccagactcctcctcgggcattggcaagacaggccagcagcccgccagaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggtcttgcccacctataacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcacacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacatggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggaccgtggcagtcaatttccagagcagcagcacagaccctgcgaccggagatgtgcatgctatgggagcattacctggcatggtgtggcaagacagagacgtgtacctgcagggtcccatttgggccaaaattcctcacacggatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 102 - protein, 733 aa, adeno-associated virus
DGYLPDWLEDNLSEGIREWWALKPGAPKPKANQQHQDNRRGLVLPGYKYLGPGNGLDKGEPVNAADAAALEYDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPATPAAVGPTTMASGGGAPMADNNEGADGVGNASGNWHCDSTWLGDRVITTSTRTWVLPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 103 - DNA, 2208 bp, adeno-associated virus
gctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgccagaaagagactcaatttcggtcagactggcgactcagagtcagtccccgaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggggacagagtcatcaccaccagcaccagaacctgggtcttgcccacctacaacaaccacctctacaagcaaatctccagtgcttcaacgggggccagcaacgacaaccactacttcggctacagcaccccctgggggtattttgatttcaacagattccactgccacttctcaccacgtgactggcagcgactcatcaacaacaactggggattccggcccaagaagctgcggttcaagctcttcaacatccaagtcaaggaggtcacgacgaatgacggcgttacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacgttcatccttctactgcctggaatatttcccatcgcagatgctgagaacgggcaataactttaccttcagctacacctttgaggaagtgcctttccacagcagctacgcgcacagccagagcctggaccggctgatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccctgtaa

SEQ ID NO: 104 - protein, 733 aa, adeno-associated virus
DGYLPDWLEDTLSEGIRQWWKLKPGPPPPKPAERHKDDSRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPSGVGPNTMAAGGGAPMADNNEGADGVGSSSGNWHCDSTWLGDRVITTSTRTWVLPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 105 - DNA, 2208 bp, adeno-associated virus
gctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctccaagcgggtgacaatccgtacctgcggtataaccacgccgacgccgagtttcaggagcgtctgcaagaagatacgtcttttgggggcaacctcgggcgagcagtcttccaggccaaaaagagggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgagggtgccgacggagtgggtaatgcctcaggaaattggcattgcgattccacatggctgggcgacagagtcatcaccaccagcacccgaacctgggccttgcccacctataacaaccacctctacaagcaaatctccagtgaaactgcaggtagtaccaacgacaacacctacttcggctacagcaccccctgggggtattttgactttaacagattccactgccacttttcaccacgtgactggcagcgactcatcaacaacaactggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccaatacctgtattacctgaacagaactcagaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagccttacctggcatggtgtggcaagatagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccaatactccacaggacaagtgagtgtggaaattgaatgggagctgcagaaagaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 106 - protein, 733 aa, adeno-associated virus
DGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 107 - DNA, 2208 bp, adeno-associated virus
gctgccgatggttatcttccagattggctcgaggacaacctctctgagggcattcgcgagtggtgggacttgaaacctggagccccgaagcccaaagccaaccaacaacaccaggacaaccgtcggggtcttgtgcttccgggttacaagtacctcggacccttcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagaaaggccaacagcccgccagaaaaagactcaattttggtcagactggcgactcagagtcagtcccagaccctcaacctctcggagaaccaccagcagcccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaagccgtgggacggtcatccttttactgcctggaatatttcccatcgcagatgctgagaacgggcaacaactttgagttcagctacagcttcgagtacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaattaaagccactaaccctgtggccaccgaaagatttgggaccgtggcagtcaatctccagagcagcagcacagaccctgcgaccggagatgtgcatgctatgggagccttacctggaatggtgtggcaagacagagacgtgtacctgcagggtcctatttgggccaaaattcctcacacagatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 108 - protein, 733 aa, adeno-associated virus
DGYLPDWLEDNLSEGIREWWDLKPGAPKPKANQQHQDNRRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPAAVGPTTMASGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYSFEYVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 109 - DNA, 2208 bp, adeno-associated virus
gctgccgatggttatcttccagattggctcgaggacaacctctctgagggcgttcgagagtggtgggcgctgcaacctggagcccctaaacccaaggcaaatcaacaacatcaggacaacgctcggggtcttgtgcttccgggttacaaatacctcggacccggtaacggactcgacaaaggagagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcatcggcaagacaggccagcagcccgccagaaagagactcaattttggtcagactggcgactcagagtcagtccccgatccacaacctctcggagaacctccagcagcgccctctggtgtgggacctaatacaatggcttcaggtggtggcgcaccaatggcagacaataacgagggtgccgatggagtgggtaattcctcaggaaattggcattgcgattccacatggctgggcgacagagtcatcaccaccagcaccagaacctgggtcttgcccacctacaacaaccacctctacaagcaaatctccagtgcttcaacgggggccagcaacgacaaccactacttcggctacagcaccccctgggggtattttgatttcaacagattccactgccacttctcaccacgtgactggcagcgactcatcaacaacaattggggattccggcccaagaagctgcggttcaagctcttcaacatccaagtcaaggaggtcacgacgaatgacggcgttacgaccatcgctaataaccttaccagcacggttcaagtcttctcggactcggagtaccagctgccgtacgtcctcggctctgcgcaccagggctgcctccctccgttcccggcggacgtgttcatgattccgcaatacggctacctaacgctcaacaatggcagccaggcagtgggacgttcatccttttactgcctggaatatttcccatcgcagatgctgagaacgggcaacaactttaccttcagctacaccttcgagtacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccccgtggccaccgaaagatttgggactgtggcagtcaatctccagagcagcagcacagaccctgcgaccggagatgtgcatgctatgggagcattacctggcatggtgtggcaagatagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 110 - protein, 733 aa, adeno-associated virus
DGYLPDWLEDNLSEGVREWWALQPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPSGVGPNTMASGGGAPMADNNEGADGVGNSSGNWHCDSTWLGDRVITTSTRTWVLPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEYVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 111 - DNA, 2208 bp, adeno-associated virus
gctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcattggcaagacaggccaacagcccgccagaaaaagactcaattttggtcagactggcgactcagagtcagtcccagaccctcaacctctcggagaacctccagcagcgccctctggtgtgggacctaatacaatggcttcaggtggtggcgcaccaatggcagacaataacgaaggtgccgacggagtgggtaatgcctcaggaaattggcattgcgattccacatggctgggcgacagagtcatcaccaccagcacccgcacctgggccttgcccacctacaacaaccacctctacaagcaaatctccagtgcttcaacgggggccagcaacgacaaccactactttggctacagcaccccctgggggtattttgatttcaacagattccactgccatttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacggttcaagtcttctcggactcggagtaccagctcccgtacgtcctcggctctgcgcaccagggctgcctccctccgttcccggcggacgtgttcatgattccgcagtacggctacctaacgctcaacaatggcagccaggcagtgggacgttcatccttttactgcctggaatatttcccatcgcagatgctgagaacgggcaacaactttgagttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggacttaagcacccgcctcctcagatcctcatcaaaaacacgcctgttcctgcgaatcctccggcagagtttttggctacaaagtttgcttcattcatcacccagtattccacaggacaagtgagcgtggagattgaatgggagctgcagaaggaaaacagcaaacgctggaatcccgaagtgcagtacacatccaactttgaaaagcagactggtgtggactttgctgttaatacagaaggcgtgtactctgaaccccgccccattggcacccgttacctcacccgtaatctgtaa

SEQ ID NO: 112 - protein, 733 aa, adeno-associated virus
DGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPSGVGPNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFLATKFASFITQYSTGQVSVEIEWELQKENSKRWNPEVQYTSNFEKQTGVDFAVNTEGVYSEPRPIGTRYLTRNL

SEQ ID NO: 113 - DNA, 2208 bp, adeno-associated virus
gctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggaacccgtcaacgcagcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtccccgaccctcaacctctcggagaacctccagcaacccccgctgctgtgggacctaatacaatggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgatttcaacagattccactgccatttctcaccacgtgactggcagcgactcatcaacaacaattggggattccggcccaagaagctgcggttcaagctcttcaacatccaagtcaaggaggtcacgacgaatgacggcgttacgaccatcgctaataaccttaccagcacggttcaagtcttctcggactcggagtaccagttgccgtacgtcctcggctctgcgcaccagggctgcctgcctccgttcccggcggacgtgttcatgattccgcagtacggctacctaacgctcaacaatggcagccaagccgtgggacgttcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggactgtggcagtcaatttccagagcagcagcacagaccctgcgaccggagatgtgcatgctatgggagcattacctggcatggtgtggcaagatagagacgtatacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 114 - protein, 733 aa, adeno-associated virus
DGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVDQSPQEPDSSSGVGKSGKQPARKRLNFGQTGDSESVPDPQPLGEPPATPAAVGPNTMAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 115 - DNA, 2208 bp, adeno-associated virus
gctgccgatggttatcttccagattggctcgaggacaacctctctgagggcattcgcgagtggtgggacttgaaacctggagcccctaaacccaaggcaaatcaacaacatcaggacaacgctcggggtcttgtgcttcctggctacaagtacctcggacccttcaacggactcgacaagggggagcccgtcaacgcggcggatgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgagggtgccgatggagtgggtaattcctcaggaaattggcattgcgattccacatggctgggcgacagagtcatcaccaccagcacccgaacatgggccttgcccacctacaacaaccacctctacaagcaaatctccagtgaaactgcaggtagtaccaacgacaacacctacttcggctacagcaccccctgggggtattttgactttaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagttgccgtacgtcctcggctctgcgcaccagggctgcctgcctccgttcccggcggacgtgttcatgattccgcagtacggctacctaacgctcaacaatggcagccaggcagtgggacggtcatccttttactgcctggagtacttcccctctcagatgctgagaacgggcaacaactttgagttcagctacaccttcgaggacgttcctttccacagcagctacgcacacagccagagcctggaccggctgatgaatcctctcatcgaccagtacctgtattacctgaacagaactcagaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatctccagagcagcagcacagaccctgcgaccggagatgtgcatgttatgggagccttacctggcatggtgtggcaagatagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttaccttacccgtcccctgtaa

SEQ ID NO: 116 - protein, 733 aa, adeno-associated virus
DGYLPDWLEDNLSEGIREWWDLKPGAPKPKANQQHQDNARGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNSSGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 117 - DNA, 2208 bp, adeno-associated virus
gctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctctcggtctggttgaggaaggcgctaagacggctcctggaaagaaacgtccggtagagcagtcgccacaagagccagactcctccacgggcatcggcaagaaaggccagcagcccgccagaaagagactcaatttcggtcagactggcgactcagagtcagtcccagaccctcaacctctcggagaacctccagcaacccccgctgctgtgggacctactacaatggcttcaggcggtggcgcaccaatggcagacaataacgaaggtgccgacggagtgggtaatgcctcaggaaattggcattgcgattccacatggatgggcgacagagtcattaccaccagcacccgaacctgggccttgcccacctacaataaccacctctacaagcaaatctccagtgcttcaacgggggccagcaacgacaaccactactttggctacagcaccccctgggggtattttgatttcaacagattccactgccacttctcaccacgtgactggcagcgactcatcaacaacaactggggattccggcccaagagactcaacttcaagctcttcaacatccaggtcaaagaggtcacgcagaatgacggtacgacgacgattgccaataaccttaccagcacggttcaggtgtttactgactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggactgtggcagtcaatttccagagcagcagcacagaccctgcgaccggagatgtgcatgctatgggagcattacctggcatggtgtggcaagatagagacgtgtacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 118 - protein, 733 aa, adeno-associated virus
DGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPARKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 119 - DNA, 2208 bp, adeno-associated virus
gctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccaacagcccgccagaaaaagactaaatttcggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcaccagaacctgggtcttgcccacctacaacaaccacctctacaagcaaatctccagtgaaactgcaggtagtaccaacgacaacacctacttcggctacagcaccccctgggggtattttgatttcaacagattccactgccatttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagctgccgtacgtcctcggctctgcgcaccagggctgcctgcctccgttcccggcggacgtcttcatgattcctcagtacggctacctaacgctcaacaatggcagccaggcagtgggacggtcatccttttactgcctggaatatttcccatcgcagatgctgagaacgggcaacaactttgagttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccctgtggccaccgaaagatttgggaccgtggcagtcaatctccagagcagcagcacagaccctgcgaccggagatgtgcatgctatgggagccttacctggaatggtgtggcaagatagagacgtgtacctgcagggtcccatttgggccaaaattcctcacacggatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccctgtaa

SEQ ID NO: 120 - protein, 733 aa, adeno-associated virus
DGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPATPAAVGPTTMASGGGAPMADNNEGADGVGNASGNWHCDSTWLGDRVITTSTRTWVLPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 121 - DNA, 2208 bp, adeno-associated virus
gctgccgatggttatcttccagattggctcgaggacaacctctctgagggcattcgtgagtggtgggctctgaaacctggagtccctcaacccaaagcgaaccaacaacaccaggacaaccgtcggggtctggtgcttcctggctacaagtacctcggacccttcaacggactcgacaagggggagcccgtcaacgcggcggacgcggcagccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagcgccctctggtgtgggacctaatacaatggctgcaggcagtggcgcaccaatggcagacaataacgagggtgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcctaagcgactcaacttcaaactcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccatcgcagatgctgagaacgggcaacaactttaccttcagctacacctttgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaattttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccctgtggccaccgaaagatttgggaccgtggcagtcaatttccagagcagcagcacagaccctgcgaccggagatgtgcatgttatgggagccttacctggaatggtgtggcaagacagagacgtgtacctgcagggtcccatttgggccaaaattcctcacacggatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgattttactgtggacaacaatggactttatactgagcctcgccccattggcacccgttaccttacccgtcccctgtaa

SEQ ID NO: 122 - protein, 733 aa, adeno-associated virus
DGYLPDWLEDNLSEGIREWWALKPGVPQPKANQQHQDNRRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGPNTMAAGSGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 123 - DNA, 2208 bp, adeno-associated virus
gctgccgatggttatcttccagattggctcgaggacaacctctctgagggcgttcgagagtggtgggcgctgcaacctggagcccctaaacccaaggcaaatcaacaacatcaggacaacgctcgaggtctggtgcttccgggttacaaataccttggacccggcaacggactcgacaagggggagccggtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccaacagcccgccagaaaaagactcaattttggtcagactggcgactcagagtcagtccccgatccacaacctctcggagaacctccagcaacccccgctgctgtgggacctactacaatggcttcaggcggtggcgcaccaatggcagacaataacgagggtgccgatggagtgggtaattcctcaggaaattggcattgcgattccacatggctgggcgacagagtcatcaccaccagcacccgaacatgggccttgcccacctacaataaccacctctacaagcaaatctccagtgaaactgcaggtagtaccaacgacaacacctacttcggctacagcaccccctgggggtattttgactttaacagattccactgccatttctcaccacgtgactggcagcgactcatcaacaacaactggggattccggcccaagaagctgcggttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcagaatcagtccggaagtgcccaaaacaaggacttgctgtttagccgtgggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgatcacagacgaagaggaaattaaagccactaaccctgtggccaccgaaagatttgggaccgtggcagtcaatctccagagcagcagcacagaccctgcgaccggagatgtgcatgctatgggagcattacctggcatggtgtggcaagatagagacgtgtacctgcagggtcctatttgggccaaaattcctcacacagatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaggaaaacagcaaacgctggaatcccgaagtgcagtatacatctaactatgcaaaatctgccaacgttgattttactgtggacaacaatggactttatactgagcctcgccccattggcacccgttacctcacccgtcccctgtaa

SEQ ID NO: 124 - protein, 733 aa, adeno-associated virus
DGYLPDWLEDNLSEGVREWWALQPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPATPAAVGPTTMASGGGAPMADNNEGADGVGNSSGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 125 - DNA, 2208 bp, adeno-associated virus
gctgccgatggttatcttccagattggctcgaggacaacctctctgaaggcgttcgagagtggtgggcgctgaaacctggagcccctaaacccaaggcaaatcaacaacatcaggacaacgctcgaggtcttgtgcttccgggttacaaatacctcggacccggcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgccagaaagagactcaattttggtcagactggcgactcagagtcagtccccgacccacaacctctcggagaacctccagcaacccccgctgctgtgggacctactacaatggctgcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaactggggattccggcccaagaagctgcggttcaagctcttcaacatccaagtcaaggaggtcacgacgaatgatggcgtcacaaccatcgctaataaccttaccagcacggttcaagtcttctcggactcggagtaccagctgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttgagttcagctacacttttgaggacgttcctttccacagcagctacgctcacagccagagtctggaccgtctcatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgattacagacgaagaggaaatcaaagccactaaccccgtggccaccgaaagatttgggaccgtggcagtcaatctccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 126 - protein, 733 aa, adeno-associated virus
DGYLPDWLEDNLSEGVREWWALKPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPATPAAVGPTTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 127 - DNA, 2208 bp, adeno-associated virus
gctgccgatggttatcttccagattggctcgaggacaacctctctgaaggcattcgtgagtggtgggctctgaaacctggagtccctcaacccaaagcgaaccaacaacaccaggacaaccgtcggggtcttgtgcttccgggttacaaatacctcggacccttcaacggactcgacaagggggaacccgtcaacgcagcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagttccagaccctcaacctctcggagaacctccagcaacccccgctgctgtgggacctaatacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccttgcccacctataacaaccacctctacaagcaaatctccagtgaaactgcaggtagtaccaacgacaacacctacttcggctacagcaccccctgggggtattttgatttcaacagattccactgccacttctcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcgccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttgagttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgattacagacgaagaggaaattaaagccactaaccctgtggccaccgaaagatttgggactgtggcagtcaatctccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctctcatgggcggctttggacttaagcacccgcctcctcagatcctcatcaaaaacacgcctgttcctgcgaatcctccggcagagttttcagctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 128 - protein, 733 aa, adeno-associated virus
DGYLPDWLEDNLSEGIREWWALKPGVPQPKANQQHQDNRRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPNTMASGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSARQGCLPPFPADVFMIPQYGYLTLNNGSQAVGRSSFYCLEYFPSQMLRTGNNFEFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 129 - DNA, 2208 bp, adeno-associated virus
gctgccgatggttatcttccagattggctcgaggacaacctctctgagggcgttcgagagtggtgggcgctgcaacctggagcccctaaacccaaggcaaatcaacaacatcaggacaacgctcggggtcttgtgcttccgggttacaaatacctcggacccggcaacggactcgacaagggggagcccgtcaacgcggcggacgcagcggccctggagcacgacaaggcctacgaccagcagctcaaagcgggagacaacccgtacctgcggtataaccacgccgacgccgagtttcaggagcgtctgcaagaagatacgtcttttgggggcaacctcgggcgagcagtcttccaggccaagaagagggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagctgccgtacgtcctcggctctgcgcaccagggctgcctccctccgttcccggcggacgtcttcatgattcctcagtacggctacctgacgctcaacaatggcagccaggcagtgggacggtcatccttttactgcctggaatatttcccatcgcagatgctgagaacgggcaataactttaccttcagctacacctttgaggaagtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaattttacctggactggtgcttcaaaatataaccttaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgatcacagacgaagaggaaatcaaagccactaaccccgtggccaccgaaagatttgggaccgtggcagtcaatctccagagcagcagcacagaccctgcgaccggagatgtgcatgttatgggagccttacctggaatggtgtggcaagacagagacgtgtacctgcagggtcccatttgggccaaaattcctcacacggatggacactttcacccgtctcctctcatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 130 - protein, 733 aa, adeno-associated virus
DGYLPDWLEDNLSEGVREWWALQPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 131 - DNA, 2208 bp, adeno-associated virus
gctgccgatggttatcttccagattggctcgaggacaacctctctgagggcattcgcgagtggtgggacctgaaacctggagccccgaaacccaaagcgaaccaacaacaccaggacaaccgtcggggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgccagaaagagactcaattttggtcagactggcgactcagagtcagtccccgacccacaacctctcggagaacctccagcaacccccgctgctgtgggacctactacaatggcttcaggcggtggcgcaccagtggcagacaataacgagggtgccgatggagtgggtaattcctcaggaaattggcattgcgattccacatggctgggcgacagagtcatcaccaccagcacccgaacatgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaatgatggcgttacgaccatcgccaataaccttaccagcacggttcaagtgtttacggactcggagtaccagctgccgtacgtcctcggctctgcgcaccagggctgcctgcctccgttcccggcggacgtgttcatgattccgcaatacggctacctgacgctcaacaatggcagccaggcagtgggacgttcatccttttactgcctggaatatttcccatcgcagatgctgagaacgggcaacaactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaattttacctggactggtgcttcaaaatataaccttaatgggcgtgaatctataatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccccgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 132 - protein, 733 aa, adeno-associated virus
DGYLPDWLEDNLSEGIREWWDLKPGAPKPKANQQHQDNRRGLVLPGYKYLGPGNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPATPAAVGPTTMASGGGAPVADNNEGADGVGNSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 133 - DNA, 2208 bp, adeno-associated virus
gctgccgatggttatcttccagattggctcgaggacaacctctctgaaggcgttcgagagtggtgggcgctgcaacctggagcccctaaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccagcagcccgccagaaagagactcaatttcggtcagactggcgactcagagtcagtccccgaccctcaacctctcggagaacctccagcagcgccctctagtgtgggatctggtacaatggctgcaggcggtggcgcaccaatggcagacaataacgaaggcgccgacggagtgggtaatgcctcaggaaattggcattgcgattccacatggctgggcgacagagtcattaccaccagcacccgcacctgggccttgcccacctataacaaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcccaagaagctgcggtttaaactcttcaacatccaagtcaaggaggtcacgacgaatgatggcgttacgaccatcgctaataaccttaccagcacggttcaagtcttctcggactcggaataccagttgccgtacgtcctcggctctgcgcaccagggctgcctccctccgttcccggcggacgtgttcatgattccgcaatacggctacctaacgctcaacaatggcagccaggcagtgggacggtcatccttctactgcctggaatatttcccatcgcagatgctgagaacgggcaataactttaccttcagctacaccttcgaggacgtgcctttccacagcagctacgctcacagccagagcctggaccggctgatgaatcctctcatcgaccagtacctgtattacctgaacagaactcaaaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataacctcaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaattaaagccactaaccccgtggccaccgaaagatttgggaccgtggcagtcaatctccagagcagcagcacagaccctgcgaccggagatgtgcatgctatgggagcattacctggcatggtgtggcaagatagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgattttactgtggacaacaatggactttatactgagcctcgccccattggcacccgttacctcacccgtaatctgtaa

SEQ ID NO: 134 - protein, 733 aa, adeno-associated virus
DGYLPDWLEDNLSEGVREWWALQPGAPKPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPSSVGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRNL

SEQ ID NO: 135 - DNA, 2256 bp, adeno-associated virus
gctgccgatggttatcttccagattggctcgaggacaacctctctgagggcattcgcgagtggtgggacttgaaacctggagcccctcaacccaaggcaaatcaacaacatcaagacaacgctcgaggtcttgtgcttccgggttacaaatacctcggacccggcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgccagaaagagactcaatttcggtcagactggcgactcagagtcagttccagaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcatcaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaagtcaaggaggtcacgacgaatgatggcgtcacaaccatcgctaataaccttaccagcacggttcaagtcttctcggactcggagtaccagctgccgtacgtcctcggctctgcgcaccagggctgcctccctccgttcccggcggacgtgttcatgattccgcaatacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaattttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgattacagacgaagaggaaattaaagccactaaccccgtggccaccgaaagatttgggactgtggcagtcaatctccagagcagcagcacagaccctgcgaccggagatgtgcatgctatgggagcattacctggcatggtgtggcaagatagagacgtgtacctgcagggtcccatttgggccaaaattcctcacacggatggacactttcacccgtctcctctcatgggcggctttggacttaagcacccgcctcctcagatcctcatcaaaaacacgcctgttcctgcgaatcctccggcggagttttcggctacaaagtttgcttcattcatcacccagtattccacaggacaagtgagcgtggagattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaaactgagcctcgccccattggcacccgttaccttacccgtcccctgtaa

SEQ ID NO: 136 - protein, 733 aa, adeno-associated virus
DGYLPDWLEDNLSEGIREWWDLKPGAPQPKANQQHQDNARGLVLPGYKYLGPGNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 137 - DNA, 2208 bp, adeno-associated virus
gctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttctcgaacctctcggtctggttgaggaaggcgctaagacggctcctggaaagaaacgtccggtagagcagtcgccacaagagccagactcctcctcgggcatcggcaagacaggccagcagcccgccagaaagagactcaatttcggtcagactggcgactcagagtcagtcccagaccctcaacctctcggagaacctccagcagcccccacaagtttgggacctactacaatggcttcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgatttcaacagattccactgccatttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctgacgctcaacaatggcagccaggcagtgggacggtcatccttttactgcctggaatatttcccatcgcagatgctgagaacgggcaacaactttaccttcagctacacctttgaggaagtgcctttccacagcagctacgctcacagccagagtctggaccgtctgatgaatcctctcatcgaccagtacctgtattacctgaacagaactcaaaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggactgtggcagtcaatctccagagcagcagcacagaccctgcgaccggagatgtgcatgctatgggagcattacctggcatggtgtggcaagatagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 138 - protein, 733 aa, adeno-associated virus
DGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPARKRLNFGQTGDSESVPDPQPLGEPPAAPTSLGPTTMASGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 139 - DNA, 32 bp, Artificial sequence
  Synthetic oligonucleotide
aagcttcgatcaactacgcagacaggtaccaa

SEQ ID NO: 140 - DNA, 41 bp, Artificial sequence
  Synthetic oligonucleotide
ataagaatgcggccgcagagaccaaagttcaactgaaacga

We claim:

1. A nucleic acid encoding an AAV capsid, the nucleic acid comprising an AAV capsid coding sequence selected from the group consisting of:
    (a) the nucleotide sequence of FIG. 3A (M41) (SEQ ID NO:1);
    (b) a nucleotide sequence that is at least 98% identical to the nucleotide sequence of FIG. 3A (M41) (SEQ ID NO:1);
    (c) a nucleotide sequence that encodes the AAV capsid encoded by the nucleotide sequence of (a) but that differs from the nucleotide sequence of (a) due to the degeneracy of the genetic code; and
    (d) a nucleotide sequence that encodes an AAV capsid that is at least 98% identical to the AAV capsid encoded by the nucleotide sequence of (a) and that substantially retains at least one property of the AAV capsid encoded by the nucleotide sequence of (a).

2. The nucleic acid of claim 1, wherein the nucleic acid is a plasmid, phage, viral vector, bacterial artificial chromosome (BAC), or yeast artificial chromosome (YAC).

3. The nucleic acid of claim 2, wherein the nucleic acid is an AAV vector comprising the coding sequence.

4. The nucleic acid of claim 3, wherein the nucleic acid further comprises an AAV Rep coding sequence.

5. A cell in vitro comprising the nucleic acid of claim 1 stably incorporated into the genome.

6. A virus particle comprising the nucleic acid of claim 1.

7. The virus particle of claim 6, wherein the virus particle is an AAV particle, an adenovirus particle, a herpesvirus particle, or a baculovirus particle.

8. A pharmaceutical formulation comprising the virus particle of claim 6 in a pharmaceutically acceptable carrier.

9. An AAV capsid encoded by the nucleic acid of claim 1.

10. The AAV capsid of claim 9 covalently linked, bound to, or encapsidating a compound selected from the group consisting of a DNA molecule, an RNA molecule, a polypeptide, a carbohydrate, a lipid, and a small organic molecule.

11. A pharmaceutical formulation comprising the AAV capsid of claim 10 in a pharmaceutically acceptable carrier.

12. An AAV particle comprising:
    an AAV vector genome; and
    the AAV capsid of claim 9, wherein the AAV capsid encapsidates the AAV vector genome.

13. The AAV particle of claim 12, wherein the AAV vector genome comprises a heterologous nucleic acid.

14. The AAV particle of claim 13, wherein the heterologous nucleic acid encodes an antisense RNA, microRNA or RNAi.

15. The AAV particle of claim 13, wherein the heterologous nucleic acid encodes a polypeptide.

16. The AAV particle of claim 15, wherein the heterologous nucleic acid encodes an immunogen.

17. The AAV particle of claim 13, wherein the heterologous nucleic acid encodes a therapeutic polypeptide.

18. A pharmaceutical formulation comprising the AAV particle of claim 12 in a pharmaceutically acceptable carrier.

19. The AAV particle of claim 1, wherein the heterologous nucleic acid encodes dystrophin, a mini-dystrophin, a micro-dystrophin, a laminin-α2, a mini-agrin, an α-sarcoglycan, a β-sarcoglycan, a γ-sarcoglycan, a δ-sarcoglycan, utrophin, Fukutin-related protein, myostatin pro-peptide, follistatin, dominant negative myostatin, IGF-1, a sarcoplasmic endoreticulum $Ca^{2+}$-ATPase (SERCA2a), a β-adrenergic receptor kinase inhibitor (βARKct), phospholamban, PI3 kinase, Pim-1, PGC-1α, SOD-1, SOD-2, EC-SOD, Kallikrein, HIF, thymosin-β4, mir-1, mir-133, mir-206, mir-208, inhibitor 1 of protein phosphatase 1, an anti-apoptotic factor, an angiogenic factor, insulin, Factor IX, Factor VIII, glucocerebrosidase, α-galactosidase A and/or lysosomal acid α glucosidase.

20. The AAV particle of claim 13, wherein the heterologous nucleic acid encodes a reporter protein.

21. A method of producing a recombinant AAV particle comprising an AAV capsid, the method comprising:
    providing a cell in vitro with a nucleic acid according to claim 1, an AAV rep coding sequence, an AAV vector genome comprising a heterologous nucleic acid, and helper functions for generating a productive AAV infection; and
    allowing assembly of the recombinant AAV particle comprising the AAV capsid and encapsidating the AAV vector genome.

22. An AAV particle produced by the method of claim 21.

23. A pharmaceutical formulation comprising the nucleic acid of claim 1 in a pharmaceutically acceptable carrier.

24. A method of delivering a nucleic acid of interest to a cell in vitro, the method comprising administering the AAV particle of claim 10 to the cell.

25. The method of claim 24, wherein the cell is a skeletal muscle cell, a cardiomyocyte, a diaphragm muscle cell, a pancreas cell, a spleen cell, a gastrointestinal cell, a lung cell, a joint cell, or a kidney cell.

* * * * *

UNITED STATES PATENT AND TRADEMARK OFFICE
CERTIFICATE OF CORRECTION

| | | |
|---|---|---|
| PATENT NO. | : 8,632,764 B2 | Page 1 of 1 |
| APPLICATION NO. | : 12/990460 | |
| DATED | : January 21, 2014 | |
| INVENTOR(S) | : Xiao et al. | |

It is certified that error appears in the above-identified patent and that said Letters Patent is hereby corrected as shown below:

<u>In the Specification:</u>

Column 1, line 14: please delete "Aspects of this invention were supported with funding" and insert -- This invention was made with government support --

Column 1, line 15: please delete "provided"

Column 1, line 16: please delete "National Institutes of Health. The United States Government" and insert -- National Institutes of Health. The government --

Column 1, line 17: please delete "has certain rights in this invention." and insert -- has certain rights in the invention. --

Signed and Sealed this
Twentieth Day of May, 2014

Michelle K. Lee
*Deputy Director of the United States Patent and Trademark Office*